US011572390B2

(12) United States Patent
Hall et al.

(10) Patent No.: US 11,572,390 B2
(45) Date of Patent: Feb. 7, 2023

(54) CHIMERIC INSECT-SPECIFIC FLAVIVIRUSES

(71) Applicant: THE UNIVERSITY OF QUEENSLAND, St Lucia (AU)

(72) Inventors: Roy Hall, St Lucia (AU); Jody Hobson-Peters, St Lucia (AU); Alexander Khromykh, St Lucia (AU); Daniel Watterson, St Lucia (AU); Mn Setoh, St Lucia (AU); Thisun Piyasena, St Lucia (AU); Agathe Colmant, St Lucia (AU); Jessica Harrison, St Lucia (AU); N Ata Lee Newton, St Lucia (AU); Laura Vet, St Lucia (AU); Helle Bielefeldt-Ohmann, St Lucia (AU)

(73) Assignee: THE UNIVERSITY OF QUEENSLAND, St Lucia (AU)

( * ) Notice: Subject to any disclaimer, the term of this patent is extended or adjusted under 35 U.S.C. 154(b) by 0 days.

(21) Appl. No.: 16/497,574

(22) PCT Filed: Sep. 7, 2017

(86) PCT No.: PCT/AU2017/050973
§ 371 (c)(1),
(2) Date: Sep. 25, 2019

(87) PCT Pub. No.: WO2018/176075
PCT Pub. Date: Oct. 4, 2018

(65) Prior Publication Data
US 2021/0107945 A1  Apr. 15, 2021

(30) Foreign Application Priority Data
Mar. 27, 2017 (AU) ................ 2017901093

(51) Int. Cl.
| C07K 14/005 | (2006.01) |
| C12N 7/00 | (2006.01) |
| A61P 31/14 | (2006.01) |
| A61K 39/12 | (2006.01) |
| G01N 33/569 | (2006.01) |

(52) U.S. Cl.
CPC ............ *C07K 14/005* (2013.01); *A61K 39/12* (2013.01); *A61P 31/14* (2018.01); *C12N 7/00* (2013.01); *G01N 33/56983* (2013.01); *C12N 2770/24121* (2013.01); *C12N 2770/24122* (2013.01); *C12N 2770/24134* (2013.01); *C12N 2770/24152* (2013.01); *G01N 2333/185* (2013.01)

(58) Field of Classification Search
None
See application file for complete search history.

(56) References Cited

U.S. PATENT DOCUMENTS

2012/0294889 A1* 11/2012 Monath .................. A61K 39/12
424/199.1

FOREIGN PATENT DOCUMENTS

| WO | 01/21807 | 3/2001 |
| WO | 03/042244 | 5/2003 |
| WO | 2010/025469 | 3/2010 |
| WO | 2010/125201 | 11/2010 |
| WO | 2012/051491 | 4/2012 |
| WO | 2012/065105 | 5/2012 |
| WO | 2012/168492 | 12/2012 |

OTHER PUBLICATIONS

Thermo Scientific's ELISA technical guide and protocols, Tech Tip #65, TR0065.0, 2010, 14 pages, available from https://assets.thermofisher.com/TFS-Assets/LSG/Application-Notes/TR0065-ELISA-guide.pdf, accessed Jul. 28, 2021. (Year: 2010).*
GenBank Accession No. YP_009164029.1, dated Sep. 14, 2015, 6 pages.
"For the Stable Expression of Heterologous Proteins in Lepidopteran Insect Cell Lines using pIZ/V5-His", Invitrogen TnsectSelect™ System, Catalog Nos. K800-01, K805-01, V8000-01, Version H, 2010, retrieved Nov. 20, 2017, 44 pages, <URL: https://assets.thermofisher.com/TFSAssets/LSG/manuals/insectselpiz_man.pdf.>.
Sandra Junglen, et al., "Host Range Restriction of Insect-Specific Flaviviruses Occurs at Several Levels of the Viral Life Cycle", mSphere, Jan./Feb. 2017, retrieved Nov. 30, 2017, vol. 2, Issue 1, e00375-16, pp. 1-15.
Juliette Kempf, et al., "Expression of the human μ opioid receptor in a stable Sf9 cell line", Journal of Biotechnology, 2002, vol. 95 (2), pp. 181-187.
Tom A. Pfeifer, et al., "Baculovirus immediate-early promoter-mediated expression of the Zeocin™ resistance gene for use as a dominant selectable marker in Dipteran and Lepidopteran insect cell lines", Gene, 1997, vol. 188, pp. 183-190.
Thisun B.H. Piyasena, et al., "Infectious DNAs derived from insect-specific flavivirus genomes enable identification of pre-and post-entry host restrictions in vertebrate cells", Scientific Reports, published Jun. 7, 2017, vol. 7: 2940, pp. 1-11.
Alexander G. Pletnev, et al., "Tick-Borne Langat/Mosquito-Borne Dengue Flavivirus Chimera, a Candidate Live Attenuated Vaccine for Protection against Disease Caused by Members of the Tick-Borne Encephalitis Virus Complex: Evaluation in Rhesus Monkeys and in Mosquitoes", Journal of Virology, Sep. 2001, vol. 75, No. 17, pp. 8259-8267.

(Continued)

*Primary Examiner* — Stacy B Chen
(74) *Attorney, Agent, or Firm* — Nixon & Vanderhye, P.C.

(57) ABSTRACT

Chimeric proteins that comprise one or more amino acid sequences of an insect-specific flavivirus and one or more other immunogenic proteins are provided. The chimeric proteins are suitably capable of forming virus particles. The chimeric protein and/or virus particle may be suitable for delivery to a subject to elicit an immune response to a pathogen and/or for diagnosis or detection of a pathogen. Also provided are nucleic acids and vectors encoding the chimeric proteins, and isolated chimeric insect-specific flaviviruses comprising the chimeric proteins and/or nucleic acids.

27 Claims, 215 Drawing Sheets

Specification includes a Sequence Listing.

(56) References Cited

OTHER PUBLICATIONS

Kentaro Yoshii, et al., "Construction and application of chimeric virus-like particles of tick-borne encephalitis virus and mosquito-borne Japanese encephalitis virus", Journal of General Virology, 2008, vol. 89, pp. 200-211.

International Search Report for PCT/AU2017/050973 dated Nov. 24, 2017, 13 pages.

Written Opinion of the ISA for PCT/AU2017/050973 dated Nov. 24, 2017, 9 pages.

* cited by examiner

>SEQ ID NO:1   PCV/WNV$_{KUN}$-prME chimeric ISF polyprotein

MNQERGILRGMGRFPPPPVKKGNKNSVAVARVPPQQGGKAREKNRERIKAPGARHGVAGK
MKSLMGELGFGWIDLLRVDLVEGIMMMVFVIQRAFAQVHRRIRGLSRRVRALEKKRDGRA
AMFIWTILAMLFGVMGVTLSNFQGKVMMTVNATDVTDIITIPTAAGKNLCIVRAMDVGHM
CDDTITYECPVLSAGNDPEDIDCWCTKLAVYVRYGRCTKTRHSRRSRRSLTVQTHGESTL
SNKKGAWMDSTKATRYLVKTESWILRNPGYALVAAVIGWMLGSNTMQRVVFAVLLLLVAP
AYSFNCLGMSNRDFLEGVSGATWVDLVLEGDSCVTIMSKDKPTIDVKMMNMEAANLAEVR
SYCYLATVSELSTKAACPTMGEAHNDKRADPSFVCKQGVVDRGWGNGCGLFGKGSIDTCA
KFACSTKATGRTILKENIKYEVAIFVHGPTTVESHGNYFTQTGAAQAGRFSITPAAPSYT
LKLGEYGEVTVDCEPRSGIDTSAYYVMTVGTKTFLVHREWFMDLNLPWSSAESNVWRNRE
TLMEFEEPHATKQSVIALGSQEGALHQALAGAIPVEFSSNTVKLTSGHLKCRVKMEKLQL
KGTTYGVCSKAFRFLGTPADTGHGTVVLELQYTGTDGPCKIPISSVASLNDLTPVGRLVT
VNPFVSVSTANAKVLIELEPPFGDSYIVVGRGEQQINHHWHKSGSSIGKAFTATLKGAQR
LAALGDTAWDFGSVGGVFTSVGKAVHQVFGGAFRSLFGGMSWITQGLLGALLLWMGINAR
DRSIALTFLAVGGVLLFLSVNVHADFGCGFDPDRKVAQCGSGSFVWKSLARWPMADHAIE
FEDSKVMVTYLTDLLMRKNKVCIVCEDVLQCAAARGVVEQITSINGIPIHHNMSLSHGRY
FPRVVKKVHNVKVGKAMLRLAMATYAGAMPESGLGVLKTGYFSRGEVQETWDDKVLRVLT
SAINAEEVCQTAVTFQYEFVRYNRKVFGSNIVLRPSAFTSKACPTYLAGAVVKNDIATFT
DGMMWMRSRKVNETWELFELETTQSHQCIWPYAYTIDLATPTDKRLFMPPQYGGPISFAN
HVPGFQVQEDFPWQKANILMRQGPVPGTTVVQDPHCDDRSAAVPVEPTMQAWCCKTCFDR
GVKPFHFVVDGKFFYPMEVRPMKLEQDAVVIETDDGEFERSEHESLFEGKAKWTSPLPMG
ETAKIQNFFVTSPPKPESSLLLVGVLIHMLTTRTRHRWATRCAGTWLIFLVFGHPVVSSV
QSWAWLFMSAALASVPGGSSLVIHFWIGLQISSAHLFYLGWLMRKRLLITEMSRVAHLIA
QLCSFETYAWAPILKVLDHLLFPLYTLSVFVVHQQFQVFHDLWLQSAVVMAHLLQHPLSG
LITLSLSVGLIQLIAPMKRWFCSPVIWGDGLRAPRPHWTALTYFIVLYLAAAGMETVGLH
TSGMTVMLGGMLLWVVLQLMPPTALELVRLPGQSLPDGCEEEASTSLPEGMSGHYAPDGV
ELVNYTDAGTVSANLVVFVGCAGIMTMNIYVGLVITALAWVTDAPMWIPRLIDGAMSQRA
NSELLLPSPPLEIHKTEDSFGYIPDGTYHVLASSWMSKKPVGVGVVKEGVFHTLHHVTKG
ANVTWAGREVRMHSGDVRRDIAAYGGPWNISGSLEDVVVVKAVNKDGTVTCCRITTAKLD
IEGTTVMAVERDFGFGSSGSPIYAPDGRLIGLYGYGFYYGTYFSIVSTGEGVEAPPEEVE
VSTREFVDWHPGRGKTRTILVEQALKHIADGKRLLILTPTRVVKDEVQRAIKEAAPQAVI
GSNLSIFRKNAVTLACHATFTQYVMEKGIESVKFSTIIMDECHFLDPMSIACRGIMDFHN
SRGTKVIFMSATPPGRAGNAGSNFTIEDRAIKFPKELTASWIKDKSIGKTIVFVPTITQA
VRLAKELGGVALTRDTFNDAMGKARSPETMFIISTDISEMGANLGVTTVIDTRTVIKPLV
SDKGVSLERVGVTPASIIQRRGRVGRREPGVYIYPLDVEPEEQPENWVCWVEAQMILDQL
GCHPMREESEFFRPQGTYRIDDVEQRRFLGLIKEKLPIWLAWTWASSHANKHQMLFQGNA
PNTGRTLKIKTPSGSHIYAPKVTDDRFEKEPEIVKVAAIGFFLKQRSLYFDLPGLLTGLY
TVLTTAGLDALGNSFKRSVDTLHDIGNAVEGEFSAIQMGRILQMWSALFIGVTLGVVLMG
AGFVVVKAFRGLFGTRQQHTTVCVSEGGSFQKVATVLMSVGPLCAVFGGIPSIFVFIVTV
ALLIVLCVGGGGSQRGVLDSDLIRWVMVLAMMTIGVTAWELELLPNVRRDVIQLTRYLFA
SNPAVVGAVFNAGNIGLGVSLPGTLMMSYAASGTLAPLIGAWAEGNFLGKLFGSEVLPAQ
AIGGFQVTAIPWGSMVPVIAGCFLATNTLSKVFGAGITTVFLILLYFDKKHAFTNKAVKV
LLARTNRRDMEEEITTRDAESRARQLFYGLQLAVSLLWVLSHPVLENFVPFFAVCGYTFL
SLLRPNHQLHAALDYTLVVLLLQVVEPGNIMYVGGCVLLWYVLNPTRLGVRSLVKSDTGG
LGFRWKKALNSLSERQFAIYKVRGVNETDKGAYVSRGGLKMNEIINKHAWEPRGVVVDLG
CGRGGWSQRLVMDYRVAEVRGYTLGGKERENPQPFQTKGYNLANLKAGVDVYKMEPVNCN
TIICDIGESDPRPEVEKTRTLKVLGMLEKWLEVNPNASFCCKVLSPYHLDVLRKLESLQH
KYNGRLVRLSYSRNSTAEMYYVSGKRANVVASVYFMLGSLVGRLRRHEPSIIDPPPVLEM
GTRSDPRAKAKAQDFEMIRRRVERLRGENRKTWFVDNEHPYVSFNYHGSFVTDEVTAGGQ
TTNPLIRRVMWPWDFLSRVTTFMMTDVSTYAQQKVLREKVDTVSEEPDERMKAINRLIMT
HFVKMFKRRGLKPRVLTPQDYMNNVQANAAIGGWSEVMDWQNVRDALADQRFWDMVDNER
ALHLRGDCELCIYNTMGKKEKKPSAFGTAKGSRTIWYMWLGSRYLEYEALGFLNEDHWVA
RENFPCGVGGVGVNYFGYYLKEIAGGGRWLIADDVAGWDTRITQGDLDDELFMLTELAPT
TYHKKLITATMTLAYKNIVALFPRNHPMYRSGTVLDVLSRTDQRGSGQVTTYALNTVTNG
KCQVGRTLEACGLLDAPLTTIDSWLTANLERVLGAMVVAGDDVVVATDNEEFHTSLRYIT
ATSKIRKNLGVSEPSPRFTSWEDVEFCSHHFHPLTLRDGRVLIAPCRDQNEIIGRSRIQK
GGIVDMASAGCLAKAHAQMWALYFFHRRDLRIGFAAITSIVPINWVPTGRISWSIHQNAE
WMTTEDMLTVWNNVWIRDNPWMRGKERVTSWTDIPYLPKGVDIKCGSLIGDSDRASWSKT
IPLVVEKTRKILEQERGTLKFYNGLSILGRYVHHVDPVFN

FIG. 12

>SEQ ID NO:2 PCV/ZIKA-prME chimeric ISF polyprotein

MNQERGILRGMGRFPPPPVKKGNKNSVAVARVPPQQGGKAREKNRERIKAPGARHGVAGK
MKSLMGELGFGWIDLLRVDLVEGIMMMVFVIQRAFAQVHRRIRGLSRRVRALEKKRDGRA
AMFIWTILAMLFGVMGAEVTRRGSAYYMYLDRNDAGEAISFPTTLGMNKCYIQIMDLGHM
CDATMSYECPMLDEGVEPDDVDCWCNTTSTWVVYGTCHHKKGEARRSRRAVTLPSHSTRK
LQTRSQTWLESREYTKHLIRVENWIFRNPGFALAAAAIAWLLGSSTSQKVIYLVMILLIA
PAYSIRCIGVSNRDFVEGMSGGTWVDVVLEHGGCVTVMAQDKPTVDIELVTTTVSNMAEV
RSYCYEASISDMASDSRCPTQGEAYLDKQSDTQYVCKRTLVDRGWGNGCGLFGKGSLVTC
AKFACSKKMTGKSIQPENLEYRIMLSVHGSQHSGMIVNDTGHETDENRAKVEITPNSPRA
EATLGGFGSLGLDCEPRTGLDFSDLYYLTMNNKHWLVHKEWFHDIPLPWHAGADTGTPHW
NNKEALVEFKDAHAKRQTVVVLGSQEGAVHTALAGALEAEMDGAKGRLSSGHLKCRLKMD
KLRLKGVSYSLCTAAFTFTKIPAETLHGTVTVEVQYAGTDGPCKVPAQMAVDMQTLTPVG
RLITANPVITESTENSKMMLELDPPFGDSYIVIGVGEKKITHHWHRSGSTIGKAFEATVR
GAKRMAVLGDTAWDFGSVGGALNSLGKGIHQIFGAAFKSLFGGMSWFSQILIGTLLMWLG
LNTKNGSISLMCLALGGVLIFLSTAVSADFGCGFDPDRKVAQCGSGSFVWKSLARWPMAD
HAIEFEDSKVMVTYLTDLLMRKNKVCIVCEDVLQCAAARGVVEQITSINGIPIHHNMSLS
HGRYFPRVVKKVHNVKVGKAMLRLAMATYAGAMPESGLGVLKTGYFSRGEVQETWDDKVL
RVLTSAINAEEVCQTAVTFQYEFVRYNRKVFGSNIVLRPSAFTSKACPTYLAGAVVKNDI
ATFTDGMMWMRSRKVNETWELFELETTQSHQCIWPYAYTIDLATPTDKRLFMPPQYGGPI
SFANHVPGFQVQEDFPWQKANILMRQGPVPGTTVVQDPHCDDRSAAVPVEPTMQAWCCKT
CFDRGVKPFHFVVDGKFFYPMEVRPMKLEQDAVVIETDDGEFERSEHESLFEGKAKWTSP
LPMGETAKIQNFFVTSPPKPESSLLLVGVLIHMLTTRTRHRWATRCAGTWLIFLVFGHPV
VSSVQSWAWLFMSAALASVPGGSSLVIHFWIGLQISSAHLFYLGWLMRKRLLITEMSRVA
HLIAQLCSFETYAWAPILKVLDHLLFPLYTLSVFVVHQQFQVFHDLWLQSAVVMAHLLQH
PLSGLITLSLSVGLIQLIAPMKRWFCSPVIWGDGLRAPRPHWTALTYFIVLYLAAAGMET
VGLHTSGMTVMLGGMLLWVVLQLMPPTALELVRLPGQSLPDGCEEEASTSLPEGMSGHYA
PDGVELVNYTDAGTVSANLVVFVGCAGIMTMNIYVGLVITALAWVTDAPMWIPRLIDGAM
SQRANSELLLPSPPLEIHKTEDSFGYIPDGTYHVLASSWMSKKPVGVGVVKEGVFHTLHH
VTKGANVTWAGREVRMHSGDVRRDIAAYGGPWNISGSLEDVVVVKAVNKDGTVTCCRITT
AKLDIEGTTVMAVERDFGFGSSGSPIYAPDGRLIGLYGYGFYYGTYFSIVSTGEGVEAPP
EEVEVSTREFVDWHPGRGKTRTILVEQALKHIADGKRLLILTPTRVVKDEVQRAIKEAAP
QAVIGSNLSIFRKNAVTLACHATFTQYVMEKGIESVKFSTIIMDECHFLDPMSIACRGIM
DFHNSRGTKVIFMSATPPGRAGNAGSNFTIEDRAIKFPKELTASWIKDKSIGKTIVFVPT
ITQAVRLAKELGGVALTRDTFNDAMGKARSPETMFIISTDISEMGANLGVTTVIDTRTVI
KPLVSDKGVSLERVGVTPASIIQRRGRVGRREPGVYIYPLDVEPEEQPENWVCWVEAQMI
LDQLGCHPMREESEFFRPQGTYRIDDVEQRRFLGLIKEKLPIWLAWTWASSHANKHQMLF
QGNAPNTGRTLKIKTPSGSHIYAPKVTDDRFEKEPEIVKVAAIGFFLKQRSLYFDLPGLL
TGLYTVLTTAGLDALGNSFKRSVDTLHDIGNAVEGEFSAIQMGRILQMWSALFIGVTLGV
VLMGAGFVVVKAFRGLFGTRQQHTTVCVSEGGSFQKVATVLMSVGPLCAVFGGIPSIFVF
IVTVALLIVLCVGGGGSQRGVLDSDLIRWVMVLAMMTIGVTAWELELLPNVRRDVIQLTR
YLFASNPAVVGAVFNAGNIGLGVSLPGTLMMSYAASGTLAPLIGAWAEGNFLGKLFGSEV
LPAQAIGGFQVTAIPWGSMVPVIAGCFLATNTLSKVFGAGITTVFLILLYFDKKHAFTNK
AVKVLLARTNRRDMEEEITTRDAESRARQLFYGLQLAVSLLWVLSHPVLENFVPFFAVCG
YTFLSLLRPNHQLHAALDYTLVVLLLQVVEPGNIMYVGGCVLLWYVLNPTRLGVRSLVKS
DTGGLGFRWKKALNSLSERQFAIYKVRGVNETDKGAYVSRGGLKMNEIINKHAWEPRGVV
VDLGCGRGGWSQRLVMDYRVAEVRGYTLGGKERENPQPFQTKGYNLANLKAGVDVYKMEP
VNCNTIICDIGESDPRPEVEKTRTLKVLGMLEKWLEVNPNASFCCKVLSPYHLDVLRKLE
SLQHKYNGRLVRLSYSRNSTAEMYYVSGKRANVVASVYFMLGSLVGRLRRHEPSIIDPPP
VLEMGTRSDPRAKAKAQDFEMIRRRVERLRGENRKTWFVDNEHPYVSFNYHGSFVTDEVT
AGGQTTNPLIRRVMWPWDFLSRVTTFMMTDVSTYAQQKVLREKVDTVSEEPDERMKAINR
LIMTHFVKMFKRRGLKPRVLTPQDYMNNVQANAAIGGWSEVMDWQNVRDALADQRFWDMV
DNERALHLRGDCELCIYNTMGKKEKKPSAFGTAKGSRTIWYMWLGSRYLEYEALGFLNED
HWVARENFPCGVGGVGVNYFGYYLKEIAGGGRWLIADDVAGWDTRITQGDLDDELFMLTE
LAPTTYHKKLITATMTLAYKNIVALFPRNHPMYRSGTVLDVLSRTDQRGSGQVTTYALNT
VTNGKCQVGRTLEACGLLDAPLTTIDSWLTANLERVLGAMVVAGDDVVVATDNEEFHTSL
RYITATSKIRKNLGVSEPSPRFTSWEDVEFCSHHFHPLTLRDGRVLIAPCRDQNEIIGRS
RIQKGGIVDMASAGCLAKAHAQMWALYFFHRRDLRIGFAAITSIVPINWVPTGRISWSIH
QNAEWMTTEDMLTVWNNVWIRDNPWMRGKERVTSWTDIPYLPKGVDIKCGSLIGDSDRAS
WSKTIPLVVEKTRKILEQERGTLKFYNGLSILGRYVHHVDPVFN

FIG. 13

>SEQ ID NO:3  PCV/DENV2-prME chimeric ISF polyprotein

MNQERGILRGMGRFPPPPVKKGNKNSVAVARVPPQQGGKAREKNRERIKAPGARHGVAGK
MKSLMGELGFGWIDLLRVDLVEGIMMMVFVIQRAFAQVHRRIRGLSRRVRALEKKRDGRA
AMFIWTILAMLFGVMGFHLTTRNGEPHMIVSRQEKGKSLLFKTKDGTNMCTLMAMDLGEL
CEDTITYKCPFLKQNEPEDIDCWCNSTSTWVTYGTCTTTGEHRREKRSVALVPHVGMGLE
TRTETWMSSEGAWKHAQRIETWILRHPGFTIMAAILAYTIGTTHFQRVLIFILLTAIAPS
MTMRCIGISNRDFVEGVSGGSWVDIVLEHGSCVTTMAKNKPTLDFELIKTEAKQPATLRK
YCIEAKLTNTTTDSRCPTQGEPTLNEEQDKRFVCKHSMVDRGWGNGCGLFGKGGIVTCAM
FTCKKNMEGKIVQPENLEYTVVITPHSGEEHAVGNDTGKHGKEVKITPQSSITEAELTGY
GTVTMECSPRTGLDFNEMVLLQMKDKAWLVHRQWFLDLPLPWLPGADTQGSNWIQKETLV
TFKNPHAKKQDVVVLGSQEGAMHTALTGATEIQMSSGNLLFTGHLKCRLRMDKLQLKGMS
YSMCTGKFKIVKEIAETQHGTIVIRVQYEGDGSPCKIPFEIMDLEKRHVLGRLITVNPIV
TEKDSPVNIEAEPPFGDSYIIIGVEPGQLKLDWFKKGSSIGQMFETTMRGAKRMAILGDT
AWDFGSLGGVFTSIGKALHQVFGAIYGAAFSGVSWTMKILIGVIITWIGMNSRSTSLSVS
LVLVGIVTLYLGVMVQADFGCGFDPDRKVAQCGSGSFVWKSLARWPMADHAIEFEDSKVM
VTYLTDLLMRKNKVCIVCEDVLQCAAARGVVEQITSINGIPIHHNMSLSHGRYFPRVVKK
VHNVKVGKAMLRLAMATYAGAMPESGLGVLKTGYFSRGEVQETWDDKVLRVLTSAINAEE
VCQTAVTFQYEFVRYNRKVFGSNIVLRPSAFTSKACPTYLAGAVVKNDIATFTDGMMWMR
SRKVNETWELFELETTQSHQCIWPYAYTIDLATPTDKRLFMPPQYGGPISFANHVPGFQV
QEDFPWQKANILMRQGPVPGTTVVQDPHCDDRSAAVPVEPTMQAWCCKTCFDRGVKPFHF
VVDGKFFYPMEVRPMKLEQDAVVIETDDGEFERSEHESLFEGKAKWTSPLPMGETAKIQN
FFVTSPPKPESSLLLVGVLIHMLTTRTRHRWATRCAGTWLIFLVFGHPVVSSVQSWAWLF
MSAALASVPGGSSLVIHFWIGLQISSAHLFYLGWLMRKRLLITEMSRVAHLIAQLCSFET
YAWAPILKVLDHLLFPLYTLSVFVVHQQFQVFHDLWLQSAVVMAHLLQHPLSGLITLSLS
VGLIQLIAPMKRWFCSPVIWGDGLRAPRPHWTALTYFIVLYLAAAGMETVGLHTSGMTVM
LGGMLLWVVLQLMPPTALELVRLPGQSLPDGCEEEASTSLPEGMSGHYAPDGVELVNYTD
AGTVSANLVVFVGCAGIMTMNIYVGLVITALAWVTDAPMWIPRLIDGAMSQRANSELLLP
SPPLEIHKTEDSFGYIPDGTYHVLASSWMSKKPVGVGVVKEGVFHTLHHVTKGANVTWAG
REVRMHSGDVRRDIAAYGGPWNISGSLEDVVVVKAVNKDGTVTCCRITTAKLDIEGTTVM
AVERDFGFGSSGSPIYAPDGRLIGLYGYGFYYGTYFSIVSTGEGVEAPPEEVEVSTREFV
DWHPGRGKTRTILVEQALKHIADGKRLLILTPTRVVKDEVQRAIKEAAPQAVIGSNLSIF
RKNAVTLACHATFTQYVMEKGIESVKFSTIIMDECHFLDPMSIACRGIMDFHNSRGTKVI
FMSATPPGRAGNAGSNFTIEDRAIKFPKELTASWIKDKSIGKTIVFVPTITQAVRLAKEL
GGVALTRDTFNDAMGKARSPETMFIISTDISEMGANLGVTTVIDTRTVIKPLVSDKGVSL
ERVGVTPASIIQRRGRVGRREPGVYIYPLDVEPEEQPENWVCWVEAQMILDQLGCHPMRE
ESEFFRPQGTYRIDDVEQRRFLGLIKEKLPIWLAWTWASSHANKHQMLFQGNAPNTGRTL
KIKTPSGSHIYAPKVTDDRFEKEPEIVKVAAIGFFLKQRSLYFDLPGLLTGLYTVLTTAG
LDALGNSFKRSVDTLHDIGNAVEGEFSAIQMGRILQMWSALFIGVTLGVVLMGAGFVVVK
AFRGLFGTRQQHTTVCVSEGGSFQKVATVLMSVGPLCAVFGGIPSIFVFIVTVALLIVLC
VGGGGSQRGVLDSDLIRWVMVLAMMTIGVTAWELELLPNVRRDVIQLTRYLFASNPAVVG
AVFNAGNIGLGVSLPGTLMMSYAASGTLAPLIGAWAEGNFLGKLFGSEVLPAQAIGGFQV
TAIPWGSMVPVIAGCFLATNTLSKVFGAGITTVFLILLYFDKKHAFTNKAVKVLLARTNR
RDMEEEITTRDAESRARQLFYGLQLAVSLLWVLSHPVLENFVPFFAVCGYTFLSLLRPNH
QLHAALDYTLVVLLLQVVEPGNIMYVGGCVLLWYVLNPTRLGVRSLVKSDTGGLGFRWKK
ALNSLSERQFAIYKVRGVNETDKGAYVSRGGLKMNEIINKHAWEPRGVVVDLGCGRGGWS
QRLVMDYRVAEVRGYTLGGKERENPQPFQTKGYNLANLKAGVDVYKMEPVNCNTIICDIG
ESDPRPEVEKTRTLKVLGMLEKWLEVNPNASFCCKVLSPYHLDVLRKLESLQHKYNGRLV
RLSYSRNSTAEMYYVSGKRANVVASVYFMLGSLVGRLRRHEPSIIDPPPVLEMGTRSDPR
AKAKAQDFEMIRRRVERLRGENRKTWFVDNEHPYVSFNYHGSFVTDEVTAGGQTTNPLIR
RVMWPWDFLSRVTTFMMTDVSTYAQQKVLREKVDTVSEEPDERMKAINRLIMTHFVKMFK
RRGLKPRVLTPQDYMNNVQANAAIGGWSEVMDWQNVRDALADQRFWDMVDNERALHLRGD
CELCIYNTMGKKEKKPSAFGTAKGSRTIWYMWLGSRYLEYEALGFLNEDHWVARENFPCG
VGGVGVNYFGYYLKEIAGGGRWLIADDVAGWDTRITQGDLDDELFMLTELAPTTYHKKLI
TATMTLAYKNIVALFPRNHPMYRSGTVLDVLSRTDQRGSGQVTTYALNTVTNGKCQVGRT
LEACGLLDAPLTTIDSWLTANLERVLGAMVVAGDDVVVATDNEEFHTSLRYITATSKIRK
NLGVSEPSPRFTSWEDVEFCSHHFHPLTLRDGRVLIAPCRDQNEIIGRSRIQKGGIVDMA
SAGCLAKAHAQMWALYFFHRRDLRIGFAAITSIVPINWVPTGRISWSIHQNAEWMTTEDM
LTVWNNVWIRDNPWMRGKERVTSWTDIPYLPKGVDIKCGSLIGDSDRASWSKTIPLVVEK
TRKILEQERGTLKFYNGLSILGRYVHHVDPVFN

FIG. 14

>SEQ ID NO:4  BgV/KUNV-prME chimeric ISF polyprotein
MSNPSVRRGVNVMAAQKKRVAQKIKSMRKGTQSISNGVRGFILFFISQIFWARKITPRVK
GLWKKLDKFQAMKVLKGLRNIINGLMRSVAGKKKRRGGNTVPFLVMMMVATTWAVTLSNF
QGKVMMTVNATDVTDIITIPTAAGKNLCIVRAMDVGHMCDDTITYECPVLSAGNDPEDID
CWCTKLAVYVRYGRCTKTRHSRRSRRSLTVQTHGESTLSNKKGAWMDSTKATRYLVKTES
WILRNPGYALVAAVIGWMLGSNTMQRVVFAVLLLLVAPAYSFNCLGMSNRDFLEGVSGAT
WVDLVLEGDSCVTIMSKDKPTIDVKMMNMEAANLAEVRSYCYLATVSELSTKAACPTMGE
AHNDKRADPSFVCKQGVVDRGWGNGCGLFGKGSIDTCAKFACSTKATGRTILKENIKYEV
AIFVHGPTTVESHGNYFTQTGAAQAGRFSITPAAPSYTLKLGEYGEVTVDCEPRSGIDTS
AYYVMTVGTKTFLVHREWFMDLNLPWSSAESNVWRNRETLMEFEEPHATKQSVIALGSQE
GALHQALAGAIPVEFSSNTVKLTSGHLKCRVKMEKLQLKGTTYGVCSKAFRFLGTPADTG
HGTVVLELQYTGTDGPCKIPISSVASLNDLTPVGRLVTVNPFVSVSTANAKVLIELEPPF
GDSYIVVGRGEQQINHHWHKSGSSIGKAFTATLKGAQRLAALGDTAWDFGSVGGVFTSVG
KAVHQVFGGAFRSLFGGMSWITQGLLGALLLWMGINARDRSIALTFLAVGGVLLFLSVNV
HAEYGCSLDFQRKELKCGDGVFVFNDANDWLTKYRYHPEDPRTLASLVKASYKAGRCGLG
SVDNMEHKMWVSLENELNAIFEENQENISVVVKESNGIYPKGNYPFTGTPEKLKYGWKTW
GKKLVFAPVLSNNTFVIDGTPDDCPYSNRVWNSFEIDEFGAGLTHTRVFLKQRLERKEEC
DNALLGAAAKGDVAVHGDPNFWMASNKTGEVWQINELMSLNLKHCTWPLSHTLHGNGVLE
SDMFVPKSIGGPVSHHNFIKGYKSQVNGPWASVPLEMHRRECPDTVVQIDQNCSGRGKST
RSTTKEGKIIRDWCCRNCTLPPVSFDGPDGCWYAMEIRPQKMNEKHLVTSWVSAGDGMEN
GNIGLVALFVCFDMFLKNKNTRKISLVGALCLLGAMILGNVGFVDLIKFMIVVGEHFRSF
NHGGDVSYLVLTAVFDIRPALLCGFVLRKKWSPSERVVMAIGMMLLQTVCGDWTQTSWWE
WLDAVGLGLLILNAVALQRWKPAILVLLTMLTPLNMRVIQGAAGGVCGVMVAMSLWKTEG
RSLRKSYLPVIGYVASAFGWGYSWIMAVYIMWATHVSRRSWPVGELAAAIGLLGAAMGMA
STKDGAMVMPIAVLGLIMVIIGMTGKCDGMEIRKVGCVSWEDSAEISGSSSRYDVALSDG
GEFQLLENSRPPWNHIIFLTLGMLASAVHPIVLGVVILAWGWFAGKSQRSGVLWDVPVAP
KVEDHGPLEDGIYTIFQNGLFGSSQAGVGVAQGGVFHTMWHVTRGGILLHKGKRLTPGWA
SVKSDLISYGGKWRLDGSWDGVEEVQLIAVPPRKNPINVQTKPSIFKLKSGEEMGAIALD
YPSGTSGSPIVNRAGVVVGLYGNGIVLNQGGYVSAISQAAVEEVSRDELPGIEGYLRKGQ
LTVLDFHPGAGKTRNFLPQILKACRTRKLRTLVLAPTRVVLSEMKEALNDHDVKYHTQAF
SSASSGRELIDAMCHATLAYRLLESTRVINWEVVIMDEAHYMDPASIAVRGWAAHRARAH
ECATIFMSATPPGTANEFPESNGGIEDIRKDIPSEAWNKGHEWILEDRRPTVWFLPSIRS
ANNIAACLRKANRTVVVLNRQTFESVYPTIKTKKPDFILATDIAEMGANLHVERVIDCRT
AFKPVLSEDQERVTLKGPMRISASAAAQRRGRVGRDPSRESDTYYYGEDTSEDNDHLVCW
TEASMILDNMEIKGGMVAPLYSVEATKTKMTPGECRLRDDQRKTFRALIKKHELPVWVSW
KVAKAGITPDDRKWCFDGEEDNTVLNDMGEKVMGRSPGGAKKALCPRWSDARLTSDNASL
MNFLAFAEGRRSYMRIVDALIMVPPMLKEKVVDAADTLALLLRSEEGSRAYKLAQESAPE
AITTLIMVTFLVLLSAGLVLMLMWPKGISKMSLGMLTMSVAGYLLLEGGLTQVQVAGILL
VFFILMVVLIPDDGSQRSINDNKLAYMMTGIILLVGAVAANEMGWLEKTKQDLFGKREEM
PGWNWDLGLDLRPGAAWTTYVALATVLGPVIDHWIQVEYGSASLTGIANSAGISAFLDKG
VPFMKVNMAVVVLFVSAWNSYSMLAIMEGCLMAGIHFCLLIPGLKARAMKKAQKRIYHGL
SKNPVVDGTPTVDIEEAEETPVLYEKKVALALLGVVAALNGIVVRTPFSMAESIVLGSAL
VGPFIEGNTSPLWNAPIAVAFAGLMRGHYSSMIGLAYNFWILQNPKRGGGETMTLGQVWK
KRLNMLDKKEFAKYKISDIHEVDRRQARTILDAGITNVGVSVSRGTSKLKWLTDRGYFKP
EGRVVDLGCGRGGWSYLAAAARETLEVKAYTLGVSGHERPIQIQSLGWNVIKFKDRVDVH
RLPIAQCDTVMCDIGESSSSWEQERERTLRVIDLMENWVAKSRPKYCFKVLAPYSSEVIE
RLELFQRRFGGGIIRVPLSRNSTHEMYYTSEVTNNIVHMVNCVSRLLLRRMTNPSGIAIL
EPDVVFPTGTRNVKGDLGPLDMEKIKMRVSKLKKENLDTWWHDENHPYRTWHYLGSYVAK
QSGSAATMVNGIVKLLSMPWDRIEDVTALAMTDTTPYGQQRVFKEKVDTRAPPPPPGTRK
IMSITNTWLFDFLGRSKQPRLCTKAEFIAKVRSHAAIGNMLEEQEGWKNAAEAVNDPRFW
ELVSEERELHLQGKCSTCIYNMMGKREKKPAEFGRAKGSRAIWYMWLGARFLEFEALGFL
NEDHWFSRDNSKGGVEGMGLQYLGYVVEDVWKKGNGIMYADDTAGWDTRITEADLEDEQY
LLEKMSGTHKKLAWAITELTYKNKVVKVPRPGPGGKILMDVIARRDQRGSGQVVTYPLNT
GTNLKTQLIRMAEGEGIITPEDTLQLSHKNEKNLREWLCTHGAERLGRMAVSGDDCIVAP
IDERFGNALSHLNAMSKIRKDIDDWEPSKPWMKWEEVPFCSHHFHHLLLKDGRRIIVPCR
NQDELIGRARVSPGNGWMIKETACHSKSYGQMWLLMYFHRRDLRLMANAISSCVPINWVP
TGRTTWSLHAGGEWMTSEDMLEVWNRVWILDNPHMSDKSVILEWRDVPYLAKSDDIRCGS
LIGTSQRACWAANIRSVVEKIRHLVGDEKYKDYLHSMDRYALEHSEIGCLI

FIG. 15

>SEQ ID NO:5      PCV polyprotein
MNQERGILRGMGRFPPPPVKKGNKNSVAVARVPPQQGGKAREKNRERIKAPGARHGVAGK
MKSLMGELGFGWIDLLRVDLVEGIMMMVFVIQRAFAQVHRRIRGLSRRVRALEKKRDGRA
AMFIWTILAMLFGVMGVVVIDMRVTYDGQVQIYRDGENMTDRVALFKLPTDGCSVGLPVS
KMCHKVDKNMKEGLADTDCGSTWAEFRLRYQRCQVKTRAKRVAPDGPKQDFLAEVEIVA
FKAIRENKSVLLVVVLCVAIAKRWPLWVLILLSIGTWTTVRGEYMEPLYVLKADQMTMIQT
TLRPEEGYVTATANGLFEMKTGRAFIYGSQVVKTLVTDCEVNATYSTDICPGGSQLSMQDIQ
AEGRACASEPYNRGWGTGCFKWGVGFVATCAEVDCTTSVKVSSVARSTIKMNVTATYHSV
KSVQSVISDVPVTFQFGQLGIASMTCRLESDRIAQSYYHVEGNKKEGLFMKEQIDGWNGATL
AAGKIANTEKIVIWGDVKPNEILVKAVSEPQLEWTNAIATHDGFRDVGFVCQIMLDKLVTG
VFKDCKTPKTSTFTQSGFGFDGIITTTLAVAQTEACSISISCKGCTLLATKAVFSAGDIESKTW
VRCGNESGTAIVGGQEVAVACATNPITQGWRLVKHATQRYRKFGMPGVGGVFHDLVGTLN
PWSFFSTTTLVFMAVVLFIVDKRILILGIACYMFYFVRADFGCGFDPDRKVAQCGSGSFVWK
SLARWPMADHAIEFEDSKVMVTYLTDLLMRKNKVCIVCEDVLQCAAARGVVEQITSINGIPI
HHNMSLSHGRYFPRVVKKVHNVKVGKAMLRLAMATYAGAMPESGLGVLKTGYFSRGEVQ
ETWDDKVLRVLTSAINAEEVCQTAVTFQYEFVRYNRKVFGSNIVLRPSAFTSKACPTYLAGA
VVKNDIATFTDGMMWMRSRKVNETWELFELETTQSHQCIWPYAYTIDLATPTDKRLFMPPQ
YGGPISFANHVPGFQVQEDFPWQKANILMRQGPVPGTTVVQDPHCDDRSAAVPVEPTMQA
WCCKTCFDRGVKPFHFVVDGKFFYPMEVRPMKLEQDAVVIETDDGEFERSEHESLFEGKAK
WTSPLPMGETAKIQNFFVTSPPKPESSLLLVGVLIHMLTTRTRHRWATRCAGTWLIFLVFGHP
VVSSVQSWAWLFMSAALASVPGGSSLVIHFWIGLQISSAHLFYLGWLMRKRLLITEMSRVA
HLIAQLCSFETYAWAPILKVLDHLLFPLYTLSVFVVHQQFQVFHDLWLQSAVVMAHLLQHP
LSGLITLSLSVGLIQLIAPMKRWFCSPVIWGDGLRAPRPHWTALTYFIVLYLAAAGMETVGL
HTSGMTVMLGGMLLWVVLQLMPPTALELVRLPGQSLPDGCEEEASTSLPEGMSGHYAPDG
VELVNYTDAGTVSANLVVFVGCAGIMTMNIYVGLVITALAWVTDAPMWIPRLIDGAMSQR
ANSELLLPSPPLEIHKTEDSFGYIPDGTYHVLASSWMSKKPVGVGVVKEGVFHTLHHVTKGA
NVTWAGREVRMHSGDVRRDIAAYGGPWNISGSLEDVVVVKAVNKDGTVTCCRITTAKLDI
EGTTVMAVERDFGFGSSGSPIYAPDGRLIGLYGYGFYYGTYFSIVSTGEGVEAPPEEVEVSTR
EFVDWHPGRGKTRTILVEQALKHIADGKRLLILTPTRVVKDEVQRAIKEAAPQAVIGSNLSIF
RKNAVTLACHATFTQYVMEKGIESVKFSTIIMDECHFLDPMSIACRGIMDFHNSRGTKVIFMS
ATPPGRAGNAGSNFTIEDRAIKFPKELTASWIKDKSIGKTIVFVPTITQAVRLAKELGGVALTR
DTFNDAMGKARSPETMFIISTDISEMGANLGVTTVIDTRTVIKPLVSDKGVSLERVGVTPASII
QRRGRVGRREPGVYIYPLDVEPEEQPENWVCWVEAQMILDQLGCHPMREESEFFRPQGTYR
IDDVEQRRFLGLIKEKLPIWLAWTWASSHANKHQMLFQGNAPNTGRTLKIKTPSGSHIYAPK
VTDDRFEKEPEIVKVAAIGFFLKQRSLYFDLPGLLTGLYTVLTTAGLDALGNSFKRSVDTLH
DIGNAVEGEFSAIQMGRILQMWSALFIGVTLGVVLMGAGFVVVKAFRGLFGTRQQHTTVCV
SEGGSFQKVATVLMSVGPLCAVFGGIPSIFVFIVTVALLIVLCVGGGGSQRGVLDSDLIRWV
MVLAMMTIGVTAWELELLPNVRRDVIQLTRYLFASNPAVVGAVFNAGNIGLGVSLPGTLM
MSYAASGTLAPLIGAWAEGNFLGKLFGSEVLPAQAIGGFQVTAIPWGSMVPVIAGCFLATNT
LSKVFGAGITTVFLILLYFDKKHAFTNKAVKVLLARTNRRDMEEEITTRDAESRARQLFYGL
QLAVSLLWVLSHPVLENFVPFFAVCGYTFLSLLRPNHQLHAALDYTLVVLLLQVVEPGNIM
YVGGCVLLWYVLNPTRLGVRSLVKSDTGGLGFRWKKALNSLSERQFAIYKVRGVNETDKG
AYVSRGGLKMNEIINKHAWEPRGVVVDLGCGRGGWSQRLVMDYRVAEVRGYTLGGKERE
NPQPFQTKGYNLANLKAGVDVYKMEPVNCNTIICDIGESDPRPEVEKTRTLKVLGMLEKWL
EVNPNASFCCKVLSPYHLDVLRKLESLQHKYNGRLVRLSYSRNSTAEMYYVSGKRANVVA
SVYFMLGSLVGRLRRHEPSIIDPPPVLEMGTRSDPRAKAKAQDFEMIRRRVERLRGENRKTW
FVDNEHPYVSFNYHGSFVTDEVTAGGQTTNPLIRRVMWPWDFLSRVTTFMMTDVSTYAQQ
KVLREKVDTVSEEPDERMKAINRLIMTHFVKMFKRRGLKPRVLTPQDYMNNVQANAAIGG
WSEVMDWQNVRDALADQRFWDMVDNERALHLRGDCELCIYNTMGKKEKKPSAFGTAKG
SRTIWYMWLGSRYLEYEALGFLNEDHWVARENFPCGVGGVGVNYFGYYLKEIAGGGRWLI
ADDVAGWDTRITQGDLDDELFMLTELAPTTYHKKLITATMTLAYKNIVALFPRNHPMYRSG
TVLDVLSRTDQRGSGQVTTYALNTVTNGKCQVGRTLEACGLLDAPLTTIDSWLTANLERVL
GAMVVAGDDVVVATDNEEFHTSLRYITATSKIRKNLGVSEPSPRFTSWEDVEFCSHHFHPLT
LRDGRVLIAPCRDQNEIIGRSRIQKGGIVDMASAGCLAKAHAQMWALYFFHRRDLRIGFAAI
TSIVPINWVPTGRISWSIHQNAEWMTTEDMLTVWNNVWIRDNPWMRGKERVTSWTDIPYLP
KGVDIKCGSLIGDSDRASWSKTIPLVVEKTRKILEQERGTLKFYNGLSILGRYVHHVDPVFN

FIG. 16

>SEQ ID NO:6    BinJV polyprotein

```
MVTKLRRPVKRAVDMMRRAVPRAAGPRRVLTRVSNTVKRNAGALRALLAYLLYQTFSGRK
VGSGARSALKRFNKNDIVKMLLAFRRTLTNIITTMQRRVKGKKRRGVQDVPLLVLLLVGA
GAMAATLRTVGDLTWLNVSTTDVGKWIRVENRHGKGECFVTATDVGTWCSDSVGYECPQI
APAYDPEDLDCYCRNTSTYVTYGRCKNGRSGRSRSKRAITIAPHGEAGLRVGSTKHWTSR
ATPQRYLMRVEKWVLRHPLPALVLVVLGWMMGRSHGQRAMYIVLMLLVAPSYGNQCLDVQ
SRDFVQGVSGGTWVDVVLDHDNCITIVADGKPSFDIRLSKMSMSKFAEYKRYCLQATMSD
VTSIVACPGAGDAHNDKSKNHEYICKAVNNDRGWGNGCVLFGKGSMETCGKFECKKKMAG
KLVARENVESVVTVHVHGASATDTKGVDTASTAKATITPKASVATLNLNDFGSLEVDCST
DVGMDFGEIVVADMSGKWWIVNKDWFNELALPWSTASTTAEVWQARDRLVEFGWPHAAKQ
NIYDIGDQEGAVTAAIAQAPMAKWESDKVELISGILKCKVKLGNLKLRGVTYSMCAQTFT
TETRPADTGHGTVAFKVKYVGTDVPCRVPLHIIDSDGGVAAGRVITAHPFVMKQNDYIIL
EVEPPFGDSKIEIGTGTTKLVEAWHRKGSSIGNAFTATYKGITKLTVLGEHAWDFNSLGG
FGASLGKAVHTLFGGVFRVMFGGMGWLTKIFVGAVLVWLGLGAHDKTIATTMILVGSILM
YMAVTVGALSEIGCSLDISRKEMKCGDGVFIFREAGMWKDGYAFHPSEPKSLAASVLKSW
QSGVCGVRSTNRMEHAMWKQIENELNGILEENEAQLSVVVRESNGTFPRGERRMHVAEPL
RYGWKTWGKTAISTVPLAKETFVVDGNDEGECPSQMRAWNSFQVEEFGTGLVKTKVFLDI
STALTAQCDTKMLGAAIKGNRSVHGDPGLWMVSAEIDGTWQIIELTLAESRRCTWPDSHT
VWGRNVQESELILPPSFGGPMTNMNKRKGYATQVGGPWNHVPLRVVFEECPGTTVSVEPN
CTRRSDSVRSTTDSGKIITDWCCRSCTMPPLTYRTPDGCWYAMEIRPKNVKEESLIRSHV
AAGVFKGIDDVSLGLLVMIIFLQEGLRRKLTATYIMWAALVVLIAGILGELTVRDVLRYL
ILVGTAFAESNNGGDLIHLALVAVFKIRPAFLFGFLFRSQWSPREGVLLASGALMLQIAS
ECLHASAIMQVVDSLSMGWLMIRAIAVPGMTSKAMPLLCACIPAVTSLLAHSTRAGIITM
AGMSLIAGSKGSSVKKHSPYMLALVVAGLGARPIGMLAMEAFSHLKGRRSWPAGEMMSAV
GLTCALVGAISGASSQDFAGPLAAAALIIIAYAISGRSADVYLEKAGEISWSEDAKISGS
SPRIDVCVTENGDFKLRHESEATWTRNCVLAACLVVAGVHPLGIPVAGLMWFGYVKSNKR
GTVLWDIPSPQATSAPTVEDGCYRVMSRRLLGSTQLGVGIMLDSTFHTMWHITRGASIVS
GEGRLDPYWADVKEDLVCYGGPWKIRNTWDGLSEVQLIAVAPKENPVNVQTMPGKFIVAN
GGEIGAVVLDYPPGTSGSPIVDQQGNVIGLYGNGVMINDQTYASAIAQAPAEVARTPTWF
TDDMLRKGQLHVLDLHPGAGKTRKVLPEILKAAVEKRLRTLVLAPTRVVAKEMHEALTGL
PVRYQTSAVAPNGSGGELIDVMCHATYTHRQLTPGRGVNYQLYIVDEAHFTDPASIAARG
IIATRVRLGHAAAIFMTATPPGMSNPFPESNAHIEDEEREVPTKAWNAGYEWITDYGGKT
VWFVPSIRMANTIAACLVRAGKTVIVLHSGSFNEEYQKTKSGNWDFVVTTDISEMGANFK
ASRVIDSRLSIKPMFSYAPSERVVIGSPRAVSPASAAQRRGRVGRDPRQLGDQYIYGGPV
GEDSAEFVHWKEARILMDNVTVPGGLYPQFYEPEGGMCDAMDGAHRLTDAKREVFRDLMK
KGELPVWLAYQVAQAGHAYTDRTWCYGGPADHQVYDDCGQTVDYRSLNGERRMLRPKWLD
QRTYNDKTSLRLFTEFAEGRRRYSELMDVFGRMPQHMLDRTILAADTFKDVLTATPGSRV
HRLALDNLPEATETMMVVGILSVSTLGVMLFLMSPKGMTRMTCGLVVIILATYFLWVSGM
AGYQIAAMQLIAFILFVVLVPEPGSQRSVQDNTIAIILIVILSLAAIIAANEAGLLEKTK
KDFAWKRESHVLVTPSPWNLDFSMDLRPATSWSLYVVMATMLGPVLEHAIVTNYASVSLT
AITNQAGILLSMDKGTPFWNLDWSVVLLCVGSWSGINGTTLMVASTMTVLHFAMILPGIR
AKAAREAQNRTAAGVSKNPLIDGLNTINIQPLPEMDPMYERKMGLWMLIAVAGAAVVFDK
RMLHYTEFGVLGSAAVSPLIEGYASAVWNTSVAASVCNLMRGHYMAGIPMAYSLIRNLSM
KGVPRRGLQATHTLGMVWKHKLNAMDKAAFNAYRKDGVTEVDREPAREAMKKGDLVSGWA
VSRGSAKLRWMHERGYIPLQGVVIDLGCGRGGWSYYAAAQRRVTAVKGLTKGGPGHEEPI
NVQSYGWNLVTFRSGVDVFHTEVQPADTLLCDIGESSADPAVEKARTVQVLVNFERWIRE
SRCEHFCCKVLGPYSPEVMERLDRLTKTYGGAVIRNPLSRNSTHEMYWVSGAKGNPVNAI
TATSRVLIERMYRRLGKSYWEEDVNLGTGTRAVSCAAEKPDLAKIGRRIELLKKEYKASW
FEDPEHPYKTWTYHGSYETKTTGSSSSMINGVVKEITHPWDTNPRVTTVCMTDTTPFGQQ
RVFKEKVDTKAREPSQGTREIMRIVSKWLTLYIGRSKRPRLCTADEFIAKVNADAALGTM
FDSQGNWANAKEAVRDPRFWQLVAKERELHLRGQCATCVYNMMGKREKKLTEFGKSKGSR
AIWFMWLGARFLEFESLGFLNEDHWLSRENSGGGVEGIGLQYLGYVLKEMALIPGGKMYA
DDTAGWDTRITNADLEDEMDILGLMDPHHKKLAKNLMELAYNNKVVRVMRPGKGGKTLMD
IISRKDQRGSGQVVTYPLNTWTNLKVQLIRMAESEGVLDPKEIDGITVTTRNNLEKWLTS
QGAERLKRIAASGDDVVVKPVDERFANALTYLNDMAKIRKDISEWKPSAGWFHWEEVPFC
SHHFHQLVLKDGRTLVVPCRDQDELIGRARVSPGAGWTIRETAGLSKAYAQMWLLMHFHR
RDLRMAGFAICSAVPSDWVPTGRTSWSLHAKGEWMTTEDMLAVWNRVWIEDNPHMSNKTL
VGSWQDIPYQRKSLDIHCGSMIGQRSRSTWAANIRISIGHVRRLIGTTEKYLDYMQEQER
FKIAEPTRLGNVI
```

FIG. 17

>SEQ ID NO:7    BgV polyprotein

MSNPSVRRGVNVMAAQKKRVAQKIKSMRKGTQSISNGVRGFILFFISQIFWARKITPRVK
GLWKKLDKFQAMKVLKGLRNIINGLMRSVAGKKKRRGGNTVPFLVMMMVATTWALTLRKI
DNTIVLNVTQNDIGKTFPVRGGNCSININDAGYWCHNTVEYDCVTIAGTEEPDDIDCWCV
GIEGVRVTYGKCSKSSPHGRRSRRAAVIPAHGGQGLSTHKETWLSTVAGERQIQRIERWI
IRNPLYAAAMVTVAYFLGSDTKQKVLLAVLMLAIGPAYGSHCIGIERRDFVHGVQGSTWV
NLVLDQGSCVTMVTENKPSVDVWLKEISLSQPTLVRRYSHTAKVHKTEIKAACPTMGEAK
LDTEHNPSYECKRTYSDRGWGNGCGLFGKGSIIACAEFSSTGHMDVYEIDMTKIEYIVNS
QIHGTVLVENNSQHAVESKFQPTTGGAEVTHAGYGTLGLDCHVQTMMDLNNFYLAVMGSD
AWLVHKQWVEDLTLPWMAGETGHWKEKKYLVEFGEPHATKMEALVLGSQEGALRTALAGA
MVVVYSQNDKKFTLKGGHVSCRARLTDLTLKGTSYPMCKGSLKFTKTPVDTGHGTAVMHV
QVTKGAPCRIGVQMADNSNGGKSLGSMITSNPIVSTDGEETLVEVSPPYGESYIIVGSGD
GKLVYHWHKTGSTIGSLFSETMKGAKRLAILGDDAWDFSSTGGVLASVGKMLHTVFGQAF
HAIFGGLSWISKIILGCVMLWIGVNSRNGTLSVTLLTVGGILLFMTLGVNAEYGCSLDFQ
RKELKCGDGVFVFNDANDWLTKYRYHPEDPRTLASLVKASYKAGRCGLGSVDNMEHKMWV
SLENELNAIFEENQENISVVVKESNGIYPKGNYPFTGTPEKLKYGWKTWGKKLVFAPVLS
NNTFVIDGTPDDCPYSNRVWNSFEIDEFGAGLTHTRVFLKQRLERKEECDNALLGAAAKG
DVAVHGDPNFWMASNKTGEVWQINELMSLNLKHCTWPLSHTLHGNGVLESDMFVPKSIGG
PVSHHNFIKGYKSQVNGPWASVPLEMHRRECPDTVVQIDQNCSGRGKSTRSTTKEGKIIR
DWCCRNCTLPPVSFDGPDGCWYAMEIRPQKMNEKHLVTSWVSAGDGMENGNIGLVALFVC
FDMFLKNKNTRKISLVGALCLLGAMILGNVGFVDLIKFMIVVGEHFRSFNHGGDVSYLVL
TAVFDIRPALLCGFVLRKKWSPSERVVMAIGMMLLQTVCGDWTQTSWWEWLDAVGLGLLI
LNAVALQRWKPAILVLLTMLTPLNMRVIQGAAGGVCGVMVAMSLWKTEGRSLRKSYLPVI
GYVASAFGWGYSWIMAVYIMWATHVSRRSWPVGELAAAIGLLGAAMGMASTKDGAMVMPI
AVLGLIMVIIGMTGKCDGMEIRKVGCVSWEDSAEISGSSSRYDVALSDGGEFQLLENSRP
PWNHIIFLTLGMLASAVHPIVLGVVILAWGWFAGKSQRSGVLWDVPVAPKVEDHGPLEDG
IYTIFQNGLFGSSQAGVGVAQGGVFHTMWHVTRGGILLHKGKRLTPGWASVKSDLISYGG
KWRLDGSWDGVEEVQLIAVPPRKNPINVQTKPSIFKLKSGEEMGAIALDYPSGTSGSPIV
NRAGVVVGLYGNGIVLNQGGYVSAISQAAVEEVSRDELPGIEGYLRKGQLTVLDFHPGAG
KTRNFLPQILKACRTRKLRTLVLAPTRVVLSEMKEALNDHDVKYHTQAFSSASSGRELID
AMCHATLAYRLLESTRVINWEVVIMDEAHYMDPASIAVRGWAAHRARAHECATIFMSATP
PGTANEFPESNGGIEDIRKDIPSEAWNKGHEWILEDRRPTVWFLPSIRSANNIAACLRKA
NRTVVVLNRQTFESVYPTIKTKKPDFILATDIAEMGANLHVERVIDCRTAFKPVLSEDQE
RVTLKGPMRISASAAAQRRGRVGRDPSRESDTYYYGEDTSEDNDHLVCWTEASMILDNME
IKGGMVAPLYSVEATKTKMTPGECRLRDDQRKTFRALIKKHELPVWVSWKVAKAGITPDD
RKWCFDGEEDNTVLNDMGEKVMGRSPGGAKKALCPRWSDARLTSDNASLMNFLAFAEGRR
SYMRIVDALIMVPPMLKEKVVDAADTLALLLRSEEGSRAYKLAQESAPEAITTLIMVTFL
VLLSAGLVLMLMWPKGISKMSLGMLTMSVAGYLLLEGGLTQVQVAGILLVFFILMVVLIP
DDGSQRSINDNKLAYMMTGIIILVGAVAANEMGWLEKTKQDLFGKREEMPGWNWDLGLDL
RPGAAWTTYVALATVLGPVIDHWIQVEYGSASLTGIANSAGISAFLDKGVPFMKVNMAVV
VLFVSAWNSYSMLAIMEGCLMAGIHFCLLIPGLKARAMKKAQKRIYHGLSKNPVVDGTPT
VDIEEAEETPVLYEKKVALALLGVVAALNGIVVRTPFSMAESIVLGSALVGPFIEGNTSP
LWNAPIAVAFAGLMRGHYSSMIGLAYNFWILQNPKRGGGETMTLGQVWKKRLNMLDKKEF
AKYKISDIHEVDRRQARTILDAGITNVGVSVSRGTSKLKWLTDRGYFKPEGRVVDLGCGR
GGWSYLAAAARETLEVKAYTLGVSGHERPIQIQSLGWNVIKFKDRVDVHRLPIAQCDTVM
CDIGESSSSWEQERERTLRVIDLMENWVAKSRPKYCFKVLAPYSSEVIERLELFQRRFGG
GIIRVPLSRNSTHEMYYTSEVTNNIVHMVNCVSRLLLRRMTNPSGIAILEPDVVFPTGTR
NVKGDLGPLDMEKIKMRVSKLKKENLDTWWHDENHPYRTWHYLGSYVAKQSGSAATMVNG
IVKLLSMPWDRIEDVTALAMTDTTPYGQQRVFKEKVDTRAPPPPPGTRKIMSITNTWLFD
FLGRSKQPRLCTKAEFIAKVRSHAAIGNMLEEQEGWKNAAEAVNDPRFWELVSEERELHL
QGKCSTCIYNMMGKREKKPAEFGRAKGSRAIWYMWLGARFLEFEALGFLNEDHWFSRDNS
KGGVEGMGLQYLGYVVEDVWKKGNGIMYADDTAGWDTRITEADLEDEQYLLEKMSGTHKK
LAWAITELTYKNKVVKVPRPGPGGKILMDVIARRDQRGSGQVVTYPLNTGTNLKTQLIRM
AEGEGIITPEDTLQLSHKNEKNLREWLCTHGAERLGRMAVSGDDCIVAPIDERFGNALSH
LNAMSKIRKDIDDWEPSKPWMKWEEVPFCSHHFHHLLLKDGRRIIVPCRNQDELIGRARV
SPGNGWMIKETACHSKSYGQMWLLMYFHRRDLRLMANAISSCVPINWVPTGRTTWSLHAG
GEWMTSEDMLEVWNRVWILDNPHMSDKSVILEWRDVPYLAKSDDIRCGSLIGTSQRACWA
ANIRSVVEKIRHLVGDEKYKDYLHSMDRYALEHSEIGCLI

FIG. 18

>SEQ ID NO:8      WNV$_{KUN}$ polyprotein
MSKKPGGPGKSRAVNMLKRGMPRVLSLTGLKRAMLSLIDGRGPTRFVLALLAFFRFTAIAPTR
AVLDRWRSVNKQTAMKHLLSFKKELGTLTSAINRRSSKQKKRGGKTGIAFMIGLIAGVGAVTL
SNFQGKVMMTVNATDVTDIITIPTAAGKNLCIVRAMDVGHMCDDTITYECPVLSAGNDPEDID
CWCTKLAVYVRYGRCTKTRHSRRSRRSLTVQTHGESTLSNKKGAWMDSTKATRYLVKTESW
ILRNPGYALVAAVIGWMLGSNTMQRVVFAVLLLLVAPAYSFNCLGMSNRDFLEGVSGATWV
DLVLEGDSCVTIMSKDKPTIDVKMMNMEAANLAEVRSYCYLATVSELSTKAACPTMGEAHN
DKRADPSFVCKQGVVDRGWGNGCGLFGKGSIDTCAKFACSTKATGRTILKENIKYEVAIFVHG
PTTVESHGNYFTQTGAAQAGRFSITPAAPSYTLKLGEYGEVTVDCEPRSGIDTSAYYVMTVGT
KTFLVHREWFMDLNLPWSSAESNVWRNRETLMEFEEPHATKQSVIALGSQEGALHQALAGAI
PVEFSSNTVKLTSGHLKCRVKMEKLQLKGTTYGVCSKAFRFLGTPADTGHGTVVLELQYTGT
DGPCKIPISSVASLNDLTPVGRLVTVNPFVSVSTANAKVLIELEPPFGDSYIVVGRGEQQINHHW
HKSGSSIGKAFTATLKGAQRLAALGDTAWDFGSVGGVFTSVGKAVHQVFGGAFRSLFGGMS
WITQGLLGALLLWMGINARDRSIALTFLAVGGVLLFLSVNVHADTGCAIDISRQELRCGSGVFI
HNDVEAWMDRYKYYPETPQGLAKIIQKAHKEGVCGLRSVSRLEHQMWEAVKDELNTLLKEN
GVDLSIVVEKQEGMYKSAPRRLTATTEKLEIGWKAWGKSILFAPELANNTFVIDGPETKECPTQ
NRAWNSLEVEDFGFGLTSTRMFLRVRESNTTECDSKIIGTAVKNNLAIHSDLSYWIESRFNDTW
KLERAVLGEVKSCTWPETHTLWGDGVLESDLIIPITLAGLRSNHNRRPGYKTQSQGPWDEGRV
EIDFDYCPGTTVTLSESCGHRGPATRTTTESGKLITDWCCRSCTLPPLRYQTDNGCWYGMEIRP
QRHDEKTLVQSQVNAYNADMIDPFQLGLLVVFLATQEVLRKRWTAKISMPAILIALLVLVFGG
ITYTDVLRYVILVGAAFAESNSGGDVVHLALMATFKIQPVFMVASFLKARWTNQENILLMLA
AAFFQMAYYDARQILLWEMPDVLNSLAVAWMILRAITFTTTSNVVVPLLALLTPGLRCLNLD
VYRILLLMVGIGSLIREKRSAAAKKKGASLLCLALASTGFFNPMILAAGLVACDPNRKRGWPA
TEVMTAVGLMFAIVGGLAELDIDSMAIPMTIAGLMFAAFVISGKSTDMWIERTADISWEGDAEI
TGSSERVDVRLDDDGNFQLMNDPGAPWKIWMLRMACLAISAYTPWAILPSVVGFWITLQYTK
RGGVLWDTPSPKEYKRGDTTTGVYRIMTRGLLGSYQAGAGVMVEGVFHTLWHTTKGAALM
SGEGRLDPYWGSVKEDRLCYGGPWKLQHKWNGQDEVQMIVVEPGKNVKNVQTKPGVFKTP
EGEIGAVTLDFPTGTSGSPIVDKNGDVIGLYGNGVIMPNGSYISAIVQGERMDEPVPAGFEPEM
LRKKQITVLDLHPGAGKTRRILPQIIKEAINRRLRTAVLAPTRVVAAEMAEALRGLPIRYQTSA
VAREHNGNEIVDVMCHATLTHRLMSPHRVPNYNLFVMDEAHFTDPASIAARGYISTRVELGE
AAAIFMTATPPGTSDPFPESNAPISDLQTEIPDRAWNSGYEWITEYIGKTVWFVPSVKMGNEIAL
CLQRAGKKVIQLNRKSYETEYPKCKNDDWDFVVTTDISEMGANFKASRVIDSRKSVKPTIITEG
EGRVILGEPSAVTAASAAQRRGRIGRNPSQVGDEYCYGGHTNEDDSNCAHWTEARIMLDNIN
MPNGLIAQFYQPEREKVYTMDGEYRLRGEERKNFLELLRTADLPVWLAYKVAAAGVSYHDR
RWCFDGPRTNTILEDNNEVEVITKLGERKILRPRWIDARVYSDHQALKSFKDFASGKRSQIGFIE
VLGKMPEHFMGKTWEALDTMYVVATAEKGGRAHRMALEELPDALQTIALIALLSVMTMGVF
FLLMQRKGIGKIGLGGVVLGAATFFCWMAEVPGTKIAGMLLLSLLLMIVLIPEPEKQRSQTDN
QLAVFLICVLTLVGAVAANEMGWLDKTKSDISGLFGQRIETKENFSIGEFLLDLRPATAWSLYA
VTTAVLTPLLKHLITSDYINTSLTSINVQASALFTLARGFPFVDVGVSALLLAAGCWGQVTLTV
TVTSATLLFCHYAYMVPGWQAEAMRSAQRRTAAGIMKNAVVDGIVATDVPELERTTPIMQK
KVGQVMLILVSLAALVVNPSVKTVREAGILITAAAVTLWENGASSVWNATTAIGLCHIMRGG
WLSCLSITWTLVKNMEKPGLKRGGAKGRTLGEVWKERLNQMTKEEFIRYRKEAITEVDRSAA
KHARKERNITGGHPVSRGTAKLRWLVERRFLEPVGKVIDLGCGRGGWCYYMATQKRVQEVR
GYTKGGPGHEEPQLVQSYGWNIVTMKSGVDVFYRPSECCDTLLCDIGESSSSAEVEEHRTLRV
LEMVEDWLHRGPKEFCVKVLCPYMPKVIEKMELLQRRYGGGLVRNPLSRNSTHEMYWVSRA
SGNVVHSVNMTSQVLLGRMEKKTWKGPQYEEDVNLGSGTRAVGKPLLNSDTSKIKNRIERLR
REYSSTWHHDENHPYRTWNYHGSYEVKPTGSASSLVNGVVRLLSKPWDTITNVTTMAMTDT
TPFGQQRVFKEKVDTKAPEPPEGVKYVLNETTNWLWAFLAREKRPRMCSREEFIRKVNSNAA
LGAMFEEQNQWRSAREAVEDPKFWEMVDEEREAHLRGECHTCIYNMMGKREKKPGEFGKA
KGSRAIWFMWLGARFLEFEALGFLNEDHWLGRKNSGGGVEGLGLQKLGYILREVGTRPGGRI
YADDTAGWDTRITRADLENEAKVLELLDGEHRRLARAIIELTYRHKVVKVMRPAADGRTVM
DVISREDQRGSGQVVTYALNTFTNLAVQLVRMMEGEGVIGPDDVEKLTKGKGPKVRTWLSE
NGEERLSRMAVSGDDCVVKPLDDRFATSLHFLNAMSKVRKDIQEWKPSTGWYDWQQVPFCS
NHFTELIMKDGRTLVTPCRGQDELVGRARISPGAGWNVRDTACLAKSYAQMWLLLYFHRRD
LRLMANAICSAVPVNWVPTGRTTWSIHAGGEWMTTEDMLEVWNRVWIEENEWMEDKTPVE
KWSDVPYSGKREDIWCGSLIGTRARATWAENIQVAINQVRSIIGDEKYVDYMSSLKRYEDTTL
VEDTVL

FIG. 19

>SEQ ID NO:9 ZIKA polyprotein
MKNPKKKSGGFRIVNMLKRGVARVSPFGGLKRLPAGLLLGHGPI
RMVLAILAFLRFTAIKPSLGLINRWGSVGKKEAMEIIKKFKKDLAAMLRIINARKEKK
RRGADTSVGIVGLLLTTAMAAEVTRRGSAYYMYLDRNDAGEAISFPTTLGMNKCYIQI
MDLGHMCDATMSYECPMLDEGVEPDDVDCWCNTTSTWVVYGTCHHKKGEARRSRRAVT
LPSHSTRKLQTRSQTWLESREYTKHLIRVENWIFRNPGFALAAAAIAWLLGSSTSQKV
IYLVMILLIAPAYSIRCIGVSNRDFVEGMSGGTWVDVVLEHGGCVTVMAQDKPTVDIE
LVTTTVSNMAEVRSYCYEASISDMASDSRCPTQGEAYLDKQSDTQYVCKRTLVDRGWG
NGCGLFGKGSLVTCAKFACSKKMTGKSIQPENLEYRIMLSVHGSQHSGMIVNDTGHET
DENRAKVEITPNSPRAEATLGGFGSLGLDCEPRTGLDFSDLYYLTMNNKHWLVHKEWF
HDIPLPWHAGADTGTPHWNNKEALVEFKDAHAKRQTVVVLGSQEGAVHTALAGALEAE
MDGAKGRLSSGHLKCRLKMDKLRLKGVSYSLCTAAFTFTKIPAETLHGTVTVEVQYAG
TDGPCKVPAQMAVDMQTLTPVGRLITANPVITESTENSKMMLELDPPFGDSYIVIGVG
EKKITHHWHRSGSTIGKAFEATVRGAKRMAVLGDTAWDFGSVGGALNSLGKGIHQIFG
AAFKSLFGGMSWFSQILIGTLLMWLGLNTKNGSISLMCLALGGVLIFLSTAVSADVGC
SVDFSKKETRCGTGVFVYNDVEAWRDRYKYHPDSPRRLAAAVKQAWEDGICGISSVSR
MENIMWRSVEGELNAILEENGVQLTVVVGSVKNPMWRGPQRLPVPVNELPHGWKAWGK
SYFVRAAKTNNSFVVDGDTLKECPLEHRAWNSFLVEDHGFGVFHTSVWLKVREDYSLE
CDPAVIGTAVKGKEAVHSDLGYWIESEKNDTWRLKRAHLIEMKTCEWPKSHTLWADGI
EESDLIIPKSLAGPLSHHNTREGYRTQMKGPWHSEELEIRFEECPGTKVHVEETCGTR
GPSLRSTTASGRVIEEWCCRECTMPPLSFRAKDGCWYGMEIRPRKEPESNLVRSVVTA
GSTDHMDHFSLGVLVILLMVQEGLKKRMTTKIIISTSMAVLVAMILGGFSMSDLAKLA
ILMGATFAEMNTGGDVAHLALIAAFKVRPALLVSFIFRANWTPRESMLLALASCLLQT
AISALEGDLMVLINGFALAWLAIRAMVVPRTDNITLAILAALTPLARGTLLVAWRAGL
ATCGGFMLLSLKGKGSVKKNLPFVMALGLTAVRLVDPINVVGLLLLTRSGKRSWPPSE
VLTAVGLICALAGGFAKADIEMAGPMAAVGLLIVSYVVSGKSVDMYIERAGDITWEKD
AEVTGNSPRLDVALDESGDFSLVEDDGPPMREIILKVVLMTICGMNPIAIPFAAGAWY
VYVKTGKRSGALWDVPAPKEVKKGETTDGVYRVMTRRLLGSTQVGVGVMQEGVFHTMW
HVTKGSALRSGEGRLDPYWGDVKQDLVSYCGPWKLDAAWDGHSEVQLLAVPPGERARN
IQTLPGIFKTKDGDIGAVALDYPAGTSGSPILDKCGRVIGLYGNGVVIKNGSYVSAIT
QGRREEETPVECFEPSMLKKKQLTVLDLHPGAGKTRRVLPEIVREAIKTRLRTVILAP
TRVVAAEMEEALRGLPVRYMTTAVNVTHSGTEIVDLMCHATFTSRLLQPIRVPNYNLY
IMDEAHFTDPSSIAARGYISTRVEMGEAAAIFMTATPPGTRDAFPDSNSPIMDTEVEV
PERAWSSGFDWVTDHSGKTVWFVPSVRNGNEIAACLTKAGKRVIQLSRKTFETEFQKT
KHQEWDFVVTTDISEMGANFKADRVIDSRRCLKPVILDGERVILAGPMPVTHASAAQR
RGRIGRNPNKPGDEYLYGGGCAETDEDHAHWLEARMLLDNIYLQDGLIASLYRPEADK
VAAIEGEFKLRTEQRKTFVELMKRGDLPVWLAYQVASAGITYTDRRWCFDGTTNNTIM
EDSVPAEVWTRHGEKRVLKPRWMDARVCSDHAALKSFKEFAAGKRGAAFGVMEALGTL
PGHMTERFQEAIDNLAVLMRAETGSRPYKAAAAQLPETLETIMLLGLLGTVSLGIFFV
LMRNKGIGKMGFGMVTLGASAWLMWLSEIEPARIACVLIVVFLLLVVLIPEPEKQRSP
QDNQMAIIIMVAVGLLGLITANELGWLERTKSDLSHLMGRREEGATIGFSMDIDLRPA
SAWAIYAALTTFITPAVQHAVTTSYNNYSLMAMATQAGVLFGMGKGMPFYAWDFGVPL
LMIGCYSQLTPLTLIVAIILLVAHYMYLIPGLQAAAARAAQKRTAAGIMKNPVVDGIV
VTDIDTMTIDPQVEKKMGQVLLIAVAVSSAILSRTAWGWGEAGALITAATSTLWEGSP
NKYWNSSTATSLCNIFRGSYLAGASLIYIVTRNAGLVKRRGGGTGETLGEKWKARLNQ
MSALEFYSYKKSGITEVCREEARRALKDGVATGGHAVSRGSAKLRWLVERGYLQPYGK
VIDLGCGRGGWSYYAATIRKVQEVKGYTKGGPGHEEPVLVQSYGWNIVRLKSGVDVFH
MAAEPCDTLLCDIGESSSSPEVEEARTLRVLSMVGDWLEKRPGAFCIKVLCPYTSTMM
ETLERLQRRYGGGLVRVPLSRNSTHEMYWVSGAKSNTIKSVSTTSQLLLGRMDGPRRP
VKYEEDVNLGSGTRAVVSCAEAPNMKIIGNRIERIRSEHAETWFFDENHPYRTWAYHG
SYEAPTQGSASSLINGVVRLLSKPWDVVTGVTGIAMTDTTPYGQQRVFKEKVDTRVPD
PQEGTRQVMSMVSSWLWKELGKHKRPRVCTKEEFINKVRSNAALGAIFEEEKEWKTAV
EAVNDPRFWALVDKEREHHLRGECQSCVYNMMGKREKKQGEFGKAKGSRAIWYMWLGA
RFLEFEALGFLNEDHWMGRENSGGGVEGLGLQRLGYVLEEMSRIPGGRMYADDTAGWD
TRISRFDLENEALITNQMEKGHRALALAIIKYTYQNKVVKVLRPAEKGKTVMDIISRQ
DQRGSGQVVTYALNTFTNLVVQLIRNMEAEEVLEMQDLWLLRRSEKVTNWLQSNGWDR
LKRMAVSGDDCVVKPIDDRFAHALRFLNDMGKVRKDTQEWKPSTGWDNWEEVPFCSHH
FNKLHLKDGRSIVVPCRHQDELIGRARVSPGAGWSIRETACLAKSYAQMWQLLYFHRR
DLRLMANAICSSVPVDWVPTGRTTWSIHGKGEWMTTEDMLVVWNRVWIEENDHMEDKT
PVTKWTDIPYLGKREDLWCGSLIGHRPRTTWAENIKNTVNMVRRIIGDEEKYMDYLST
QVRYLGEEGSTPGVL

FIG. 20

>SEQ ID NO:10          DENV2 polyprotein

MNNQRKKARNTPFNMLKRERNRVSTVQQLTKRFSLGMLQGRGPLKLFMALVAFLRFLTIPPT
AGILKRWGTIKKSKAINVLRGFRKEIGRMLNILNRRRRTAGMIIMLIPTVMAFHLTTRNGEPHM
IVSRQEKGKSLLFKTKDGTNMCTLMAMDLGELCEDTITYKCPFLKQNEPEDIDCWCNSTSTWV
TYGTCTTTGEHRREKRSVALVPHVGMGLETRTETWMSSEGAWKHAQRIETWILRHPGFTIMA
AILAYTIGTTHFQRVLIFILLTAIAPSMTMRCIGISNRDFVEGVSGGSWVDIVLEHGSCVTTMAK
NKPTLDFELIKTEAKQPATLRKYCIEAKLTNTTTDSRCPTQGEPTLNEEQDKRFVCKHSMVDR
GWGNGCGLFGKGGIVTCAMFTCKKNMEGKIVQPENLEYTVVITPHSGEEHAVGNDTGKHGK
EVKITPQSSITEAELTGYGTVTMECSPRTGLDFNEMVLLQMKDKAWLVHRQWFLDLPLPWLP
GADTQGSNWIQKETLVTFKNPHAKKQDVVVLGSQEGAMHTALTGATEIQMSSGNLLFTGHLK
CRLRMDKLQLKGMSYSMCTGKFKIVKEIAETQHGTIVIRVQYEGDGSPCKIPFEIMDLEKRHVL
GRLITVNPIVTEKDSPVNIEAEPPFGDSYIIIGVEPGQLKLDWFKKGSSIGQMFETTMRGAKRMA
ILGDTAWDFGSLGGVFTSIGKALHQVFGAIYGAAFSGVSWTMKILIGVIITWIGMNSRSTSLSVS
LVLVGIVTLYLGVMVQADSGCVVSWKNKELKCGSGIFVTDNVHTWTEQYKFQPESPSKLASA
IQKAHEEGICGIRSVTRLENLMWKQITSELNHILSENEVKLTIMTGDIKGIMQVGKRSLRPQPTE
LRYSWKTWGKAKTLSTELHNQTFLIDGPETAECPNTRAWNSLEVEDYGFGVFTTNIWLRLR
EKQDVFCDSKLMSAAIKDNRAVHADMGYWIESALNDTWKIEKASFIEVKSCHWPKSHTLWSN
GVLESEMVIPKNFAGPVSQHNNRPGYHTQTAGPWHLGKLEMDFDFCEGTTVVVTEDCGNRGP
SLRTTTASGKLITEWCCRSCTLPPLRYRGEDGCWYGMEIRPLKEKEENLVSSLVTAGHGQIDNF
SLGILGMALFLEEMLRTRVGTKHAILLVAVSFVTLITGNMSFRDLGRVMVMVGATMTDDIGM
GVTYLALLAAFKVRPTFTAGLLLRKLTSKELMMTTIGIVLLSQSSIPETILELTDALALGMMVL
KMVRNMEKYQLAVTIMAILCVPNAVILQNAWKVSCTILAVVSVSPLLLTSSQQKADWIPLALT
IKGLNPTAIFLTTLSRTSKKRSWPLNEAIMAVGMVSILASSLLKNDIPMTGPLVAGGLLTVCYV
LTGRSADLELERATDVKWDDQAEISGSSPILSITISEDGSMSIKNEEEEQTLTILIRTGLLVISGLF
PVSIPITAAAWYLWEVKKQRAGVLWDVPSPPPVGKAELEDGAYRIKQKGILGYSQIGAGVYKE
GTFHTMWHVTRGAVLMHKGKRIEPSWADVKKDLISYGGGWKLEGEWKEGEEVQVLALEPG
KNPRAVQTKPGLFRTNTGTIGAVSLDFSPGTSGSPIVDKKGKVVGLYGNGVVTRSGAYVSAIA
QTEKSIEDNPEIEDDIFRKRRLTIMDLHPGAGKTKRYLPAIVREAIKRGLRTLILAPTRVVAAEM
EEALRGLPIRYQTPAIRAEHTGREIVDLMCHATFTMRLLSPIRVPNYNLIIMDEAHFTDPASIAA
RGYISTRVEMGEAAGIFMTATPPGSRDPFPQSNAPIMDEEREIPERSWNSGHEWVTDFKGKTV
WFVPSIKTGNDIAACLRKNGKRVIQLSRKTFDSEYVKTRTNDWDFVVTTDISEMGANFKAERV
IDPRRCMKPVILTDGEERVILAGPMPVTHSSAAQRRGRIGRNPRNENDQYIYMGEPLENDEDC
AHWKEAKMLLDNINTPEGIIPSMFEPEREKVDAIDGEYRLRGEARKTFVDLMRRGDLPVWLA
YKVAAEGINYADRRWCFDGTRNNQILEENVEVEIWTKEGERKKLKPRWLDARIYSDPLALKE
FKEFAAGRKSLTLNLITEMGRLPTFMTQKARDALDNLAVLHTAEAGGKAYNHALSELPETLET
LLLLTLLATVTGGIFLFLMSGRGIGKMTLGMCCIITASILLWYAQIQPHWIAASIILEFFLIVLLIP
EPEKQRTPQDNQLTYVIIAILTVVAATMANEMGFLEKTKKDLGLGNIATQQPESNILDIDLRPA
SAWTLYAVATTFITPMLRHSIENSSVNVSLTAIANQATVLMGLGKGWPLSKMDIGVPLLAIGC
YSQVNPITLTAALLLLVAHYAIIGPGLQAKATREAQKRAAAGIMKNPTVDGITVIDLDPIPYDP
KFEKQLGQVMLLVLCVTQVLMMRTTWALCEALTLATGPVSTLWEGNPGRFWNTTIAVSMAN
IFRGSYLAGAGLLFSIMKNTTSTRRGTGNIGETLGEKWKSRLNALGKSEFQIYKKSGIQEVDRT
LAKEGIKRGETDHHAVSRGSAKLRWFVERNLVTPEGKVVDLGCGRGGWSYYCGGLKNVREV
KGLTKGGPGHEEPIPMSTYGWNLVRLQSGVDVFFVPPEKCDTLLCDIGESSPNPTVEAGRTLRV
LNLVENWLNNNTQFCVKVLNPYMPSVIERMETLQRKYGGALVRNPLSRNSTHEMYWVSNAS
GNIVSSVNMISRMLINRFTMRHKKATYEPDVDLGSGTRNIGIESETPNLDIIGKRIEKIKQEHETS
WHYDQDHPYKTWAYHGSYETKQTGSASSMVNGVVRLLTKPWDVVPMVTQMAMTDTTPFG
QQRVFKEKVDTRTQEPKEGTKKLMKITAEWLWKELGKKKTPRMCTREEFTKKVRSNAALGAI
FTDENKWKSAREAVEDSRFWELVDKERNLHLEGKCETCVYNMMGKREKKLGEFGKAKGSR
AIWYMWLGARFLEFEALGFLNEDHWFSRENSLSGVEGEGLHKLGYILREVSKKEGGAMYAD
DTAGWDTRITIEDLKNEEMITNHMAGEHKKLAEAIFKLTYQNKVVRVQRPTPRGTVMDIISRR
DQRGSGQVGTYGLNTFTNMEAQLIRQMEGEGIFKNIQHLTASEEIAVQDWLVRVGRERLSRM
AISGDDCVVKPLDDRFARALTALNDMGKVRKDIQQWEPSRGWNDWTQVPFCSHHFHELIMK
DGRTLVVPCRNQDELIGRARISQGAGWSLRETACLGKSYAQMWSLMYFHRRDLRLAANAICS
AVPSHWVPTSRTTWSIHASHEWMTTEDMLTVWNKVWILENPWMEDKTPVESWEEIPYLGKR
EDQWCGSLIGLTSRATWAKNIQTAINQVRSLIGNEEYTDYMPSMKRFRREEEEAGVLW

FIG. 21

>SEQ ID NO:11      PCV/WNV$_{KUN}$-prME chimeric ISF vector
```
   1 gggtcggcat ggcatctcca cctcctgcg gtccgacctg ggcatccgaa ggaggacgtc
  61 gtccactcgg atggctaagg gagagccact tttctctcga ttctctatcg aatctaggg
 121 agctcggatc cagacatgat aagatacatt gatgagtttg acaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 ttttaaaaaa cttttgcgtt agtaaaacca cggagttttg gtttgctgag aatagtgcga
1021 gggttgtttt aattatttcg gagatttttgg ttcgtgatga atcaggagag aggaatactc
1081 aggggtatgg ggaggttccc cccccccct gtgaagaagg ggaacaagaa ttctgttgcc
1141 gtggccaggg tgccaccgca gcaaggagga aaagcgagag agaaaaaccg tgagaggatt
1201 aaagcgccag gagcgcgaca tggagttgcc ggaaagatga aaagtctaat gggagaattg
1261 ggctttggat ggattgattt actacgcgtt gatttggtgg aaggaattat gatgatggtt
1321 tttgttatac agcgggcttt cgcccaagtg caccggagaa ttagaggatt atcaagacgc
1381 gtcagggcat tggagaagaa gcgtgacggt cgagcggcta tgttcatttg gactatattg
1441 gcaatgttat tcggagttat gggagtcact ctctccaact ttcaagggaa ggtgatgatg
1501 acggtgaacg ctactgacgt cacagacatt atcacgatac caacggccgc tggaaagaac
1561 ctgtgcattg tcagagctat ggatgtgggg cacatgtgtg atgatactat cacctatgaa
1621 tgtccagtgt tgtcggccgg aaatgatcca gaagacattg actgctggtg cacgaagtta
1681 gcagtctacg ttaggtatgg aagatgcacc aagacacgac actcaagacg cagcagaagg
1741 tcactaacag tgcagacgca tggagagagc accctatcga acaaaaaggg ggcctggatg
1801 gacagcacca aggctacaag gtacttggta aaaacagaat catggatctt gagaaaccct
1861 ggatatgcct tggtggcagc tgtcattgga tggatgctcg gaagcaacac catgcagcgt
1921 gtcgtgtttg ccgtgttact gcttttggta gctccagctt acagctttaa ctgtcttgga
1981 atgagcaaca gagatttcct ggagggagtg tccggagcaa catgggtgga cttggtcctt
2041 gaaggtgaca gctgtgtgac cattatgtcc aaggacaagc ccaccatcga tgtgaagatg
2101 atgaacatgg aggccgctaa cttagcagaa gtccgcagtt attgctactt agccactgtc
2161 agtgaactct ccaccaaggc tgcgtgccca accatggggg aagcccataa tgacaagcgg
2221 gctgacccat cttttgtgtg caaacaagga gtagtggata gaggttgggg caatgggtgc
2281 ggacttttttg gtaaaggaag catcgacaca tgcgccaaat tgcctgttc aaccaaggca
2341 acgggaagga ctatcttaaa ggagaacatt aagtatgagg tggctatctt tgtgcatgga
2401 ccaactaccg tggaatcgca tgggaactac ttcacgcaaa ccggagctgc tcaggctggg
2461 agatttagta tcacccccgc ggcaccctct tacactctta agctcggaga gtatggagaa
2521 gtaacagtgg actgtgaacc acgctcaggg atagacacca gtgcatacta tgtgatgact
2581 gtcgggacaa agacttttct ggtccaccgt gagtggttta tggacctcaa cctcccctgg
2641 agcagtgctg aaagtaatgt ttggaggaac agagagacgc taatggaagtt tgaagaacca
2701 cacgctacga agcaatctgt gatagcattg ggctctcaag agggagccct gcatcaagct
2761 ctggcaggag ccattcctgt ggaattttca agcaacactg tcaagctgac gtcaggccac
2821 ctgaagtgta gggtgaagat ggaaaaattg cagctgaagg ggacaactta tggcgtctgt
2881 tcaaaggcct tcagattcct tgggactccc gcagacacgg gccatgtac tgtggtactg
2941 gaactgcagt acacaggcac ggatggaccc tgcaagatac ccatttcatc agtagcttca
```

FIG. 22

```
3001 ttgaatgacc taacgccagt gggcaggtta gttaccgtca accccttgt ctccgtgtca
3061 acggccaatg ctaaagtcct gattgagttg gaaccaccct ttggagattc gtacatagtg
3121 gtgggaagag gagagcaaca gatcaaccat cactggcaca agtctggaag tagcattggc
3181 aaagctttca cagccaccct caagggagct cagagactag cagctctggg agacacagct
3241 tgggactttg gatcggttgg aggagtgttt acctccgtgg gaaaggctgt ccatcaagta
3301 tttggtggag cattccgctc attgtttgga ggcatgtctt ggataactca gggtctgctg
3361 ggggccctcc tattgtggat gggtattaac gctcgtgata gatccatagc cctcacgttc
3421 ctcgcggttg gaggagttct gctctttctc tccgtgaacg tgcatgctga cttcggatgt
3481 ggatttgacc cagataggaa ggtagcacag tgtggttctg gctcattcgt gtggaagtca
3541 ctggcccgtt ggccaatggc tgatcacgct attgagtttg aagatagcaa agtgatggtg
3601 acttacttga ctgacctatt gatgagaaag aacaaagtct gcatagtgtg tgaagatgta
3661 ttgcagtgtg ccgcagcgcg tggagttgtc gagcagataa cgtcgatcaa tggaatccca
3721 atccatcaca acatgtcgct gtcgcatggc cgatatttcc cacgtgtagt gaagaaagta
3781 cacaatgtta aggtgggaaa agccatgttg cgccttgcaa tggccacata tgcgggagcg
3841 atgcctgaga gtggattggg tgttttgaag acggggtatt tttcacgcgg agaagtgcag
3901 gaaacgtggg atgataaagt tctaagagtc ctaaccagcg ccataaatgc agaggaagtg
3961 tgccagacgg ctgtcacgtt ccagtatgag ttcgttcgat ataaccggaa agtctttgga
4021 tctaacatcg tgttgcgacc ttcagccttt acgagcaaag cttgcccaac atatttagct
4081 ggggctgtgg tcaaaaacga catagcaacg tttacggacg gaatgatgtg gatgcggagc
4141 cggaaagtca atgaaacgtg ggaactgttt gagttggaaa caacccaaag ccaccaatgc
4201 atttggccat acgcgtacac aatagaccta gcaacaccca cggacaagag gctttcatg
4261 ccgccacaat acggaggacc aatttcgttt gcgaaccacg tgcctggatt ccaggtgcaa
4321 gaggactttc cctggcagaa ggcgaatata ttaatgcgcc agggaccggt tccgggaacg
4381 accgtagtcc aggatccaca ctgtgatgac cggagcgcgg cagtgccagt tgaaccaact
4441 atgcaagctt ggtgctgcaa gacctgtttt gatagaggag tgaagccttt ccattttgtg
4501 gttgacggga aattttctca tccaatggaa gtgcggccaa tgaaactgga acaagacgct
4561 gtggtgattg agactgatga tggagagttc gagaggagtg agcatgagag cttgtttgaa
4621 ggcaaagcaa agtggacatc accgttacca atgggagaaa cagccaagat tcaaaatttt
4681 ttcgtgacca gcccgccaaa gccggaatca agcctgcttt tggtgggcgt tctgattcat
4741 atgttaacaa cgcgaacccg ccatcggtgg gcaactcgtt gtgctggaac ttggctcatc
4801 tttttggtct ttggacatcc ggttgtgtct tcggtgcagt cttgggcgtg gctctttatg
4861 tcagctgcct tagcaagtgt ccctggtggt tcttcactgg tgatccactt ctggattggg
4921 ttgcagatat cgtcagcgca cctctttac ctgggttggt taatgaggaa acgcctgttg
4981 attacagaga tgtcgcgagt ggcacatctg attgcccagt tgtgcagctt cgagacatat
5041 gcgtgggcac cgatcctcaa agtactggat cacttgctgt ttccactcta cactctgtca
5101 gtattcgtcg ttcaccagca gtttcaggta ttcacgact tgtggctaca gagcgccgtg
5161 gtgatggcac acctgttgca acaccctctc agtggtttaa taaccttgag tttaagcgtc
5221 ggcttgattc agctaatagc accaatgaaa agatggtttt gctcaccagt tatatgggga
5281 gatggcttac gcgcgccgag accacactgg acagccttaa cgtatttcat cgtgctgtat
5341 ttggcagccg ctgggatgga gacagtgggt ctgcacacgt ccgggatgac agtgatgctg
5401 ggcgggatgc ttctgtgggt tgtcctacag ttgatgcccc cgacagcctt ggaacttgtg
5461 cgcctaccgg gacaaagtct gccagacgga tgtgaagaag aagcgtcaac atctctacca
5521 gaaggaatga gtgggcatta cgcccccgat ggagttgaac tcgtgaacta cacagatgca
5581 gggactgtct ccgcaaacct tgtggtattt gttgggtgtg ctggaattat gactatgaac
5641 atatacgttg ggttggttat cacggccttg gcctgggtaa cggacgcccc gatgtggatt
5701 ccaagattga ttgatggtgc tatgtcccag cgggcaaatt cggagctatt gctgccatcc
5761 ccacctcttg agatacacaa gacggaagac tcgtttggtt acatcccgga cggaacatat
5821 cacgtgttgg ctagcagctg gatgagcaag aaaccagttg gtgttggagt ggtgaaggag
5881 ggcgtgtttc acacgttaca ccacgtcacc aaaggagcta atgtgacatg gcaggacgt
5941 gaggttagga tgcactctgg agatgttagg cgggatattg ctgcctatgg cgggccctgg
6001 aacatcagcg ggagtcttga agatgtcgta gtagtgaagg ccgtgaacaa ggatggaacc
```

6061 gtgacatgct gccggattac aacagctaag ttggacattg aaggaactac agtgatggct
6121 gttgagcgag attttggttt cggctcttcg gggtccccca tatacgctcc tgatggacgg
6181 ttgattggct tgtatggata cgggttttac tatggaacgt acttctcaat agttttcaaca
6241 ggagaaggag tggaggcacc accggaagag gttgaagtct caacacgtga gtttgtggac
6301 tggcaccctg gaagaggaaa aacgcgcacg atactcgttg agcaggccct gaagcatata
6361 gctgatggaa agaggttgct aattttgaca ccaacgcggg tcgtaaagga tgaagtgcag
6421 cgagcgataa aggaagccgc cccgcaggcg gttatcggat cgaacttaag cattttcgg
6481 aagaacgccg ttaccttggc atgccacgcg accttcacgc agtatgtgat ggagaagggg
6541 atagaaagtg tgaagttttc gaccatcatt atggacgagt gccactttct ggacccgatg
6601 tccatcgcgt gccgcgggat aatggatttc cacaacagcc gtggaacgaa ggtcatcttc
6661 atgagtgcga cgcccccagg acgagcagga aacgctgggt ccaactttac aatagaagac
6721 agagccatca agttccccaa ggagttgacc gcatcgtgga tcaaagacaa gtcaataggc
6781 aagaccatcg ttttgtgcc aacaattacg caagctgtga ggctggctaa agagttggga
6841 ggggtggcct tgacccgaga tacgttcaat gatgccatgg ggaaggcccg gagtccggaa
6901 acaatgttta taatctcaac agacatcagc gagatgggag ccaatctcgg agtgactact
6961 gttatcgaca caagaactgt tataaaacca ttagtgtctg acaaaggagt ttcacttgaa
7021 agggttggtg tgaccccagc ttcaatcatc cagcgcaggg gccgagtagg tcggcgggag
7081 cccggagtat acatttatcc ccttgacgtc gaaccagagg agcagccgga aaattgggtg
7141 tgttgggtgg aggcgcaaat gatcttagat caattgggct gccatccgat gagagaggag
7201 agcgaatttt tccgcccaca aggcacgtac cggattgacg acgtagagca gcggaggttt
7261 ctggggttga tcaaggaaaa actgccaatt tggcttgctt ggacttgggc cagctcacat
7321 gcgaacaaac atcagatgct atttcaggga aacgccccca acactggacg aacattaaaa
7381 ataaagacgc catccggatc tcacatttac gccccaaagg tgacagatga taggtttgaa
7441 aaggagccag aaattgtgaa agtggcggcc atcggattct tcctaaagca gagatcacta
7501 tacttcgact tacctggatt attgaccgga ttgtacacgg tgttgacaac ggctgggctc
7561 gatgcccttg gaaattcgtt caaacgctct gtggacaccc ttcacgacat cggaaatgcg
7621 gtggaaggag agttttctgc tatacaaatg ggacggattt tacagatgtg gtctgcgttg
7681 tttatcgggg tgactttggg agttgtgctg atgggagccg gatttgttgt ggtgaaggct
7741 tttagaggat tgttggaac ccgccaacaa cacacaactg tgtgcgtgtc ggagggcgga
7801 agtttccaaa aagttgccac ggttctaatg agcgttggac cattgtgcgc cgtttttggt
7861 ggcattccct ctatattcgt cttcattgtg accgttgccc tgttgattgt gctgtgtgtg
7921 ggcggaggtg gctctcaacg tggtgtgctt gattcggatc taatacgctg ggtcatggtg
7981 ttggccatga tgacaatcgg agtgactgcg tgggagttgg agctattacc aaacgtgaga
8041 agagatgtta tacagttgac tcgatacctg tttgctagca atcctgccgt tgttggagct
8101 gtgtttaacg ccgggaatat cggattggga gtctctctgc cagggaccct catgatgagc
8161 tacgccgcga gcggaacgct ggcccccctt attggagcgt gggccgaagg aaatttctta
8221 ggaaagctct ttggtagcga agtgcttcca gctcaggcta taggcggatt tcaagtgaca
8281 gctatcccgt ggggatctat ggtgccggtt atcgctggtt gctttctagc gacaaacact
8341 ctttcgaaag tgtttggtgc tggaattaca actgtgtttc tcatactact ctacttcgac
8401 aagaaacatg cattcacgaa caaggctgtt aaggttttgt tggcgcggac aaacagaagg
8461 gacatggagg aagaaatcac aacaagggac gcggagtcgc gggctcgcca actgttttat
8521 ggcctacaac tggccgtatc gttgctgtgg gttctctcac atcctgtgtt ggaaaacttc
8581 gttccattct ttgctgtgtg cgggtacaca ttcctgtcgc tcttgaggcc aaatcatcaa
8641 ctacatgctg cgttggatta tacattggta gtcctgctct tgcaggtagt tgaacctggg
8701 aacatcatgt acgtcggcgg atgcgtttg ttatggtatg ttttaaaccc taccagattg
8761 ggcgtgcgct cgctggtgaa gagtgacacc ggaggtttag gcttccgttg gaagaaagcg
8821 ttgaattcac ttagtgagag gcagtttgcc atctacaaag tcagaggcgt gaatgaaact
8881 gataaaggag cctacgtgtc gcgaggtggt ttaaaaatga acgagattat caacaagcat
8941 gcgtgggaac ctcgaggagt tgtcgttgac ctgggatgtg gacgaggagg ttggtcccag
9001 cgcttggtga tggattaccg cgtcgctgaa gtaagaggat acacacttgg aggcaaagaa
9061 cgtgagaatc cccaaccgtt ccaaacgaaa ggatataact tggcgaattt gaaggctgga

FIG. 22 cont.

9121 gttgacgtct ataaaatgga gccagtgaat tgtaacacca taatttgcga cataggtgag
9181 agtgacccgc gtcctgaagt tgaaaaaact cgaacgctga aggttttggg aatgctggag
9241 aaatggctgg aagtcaatcc aaacgcctct ttttgctgca aagtgctatc accttatcac
9301 ttggacgtgc ttcgaaagtt agagtcgctg caacacaagt ataacgggcg gctggttcga
9361 ctgtcttaca gtcggaactc aacagcagaa atgtattatg tgtcaggaaa gagggcaaac
9421 gtggtggcaa gcgtgtactt catgcttggg tcgctggtag gtaggctgcg gagacatgag
9481 ccatcaatca tcgaccccc accggttcta gagatgggaa ccagaagcga tccgcgagca
9541 aaggccaaag cgcaagactt cgagatgatc cgaagaagag tggaacgact acgaggagaa
9601 aatcggaaaa catggtttgt ggacaacgaa catccatatg tgtcatttaa ctaccatgga
9661 tccttcgtga ctgatgaggt gacagcgggc ggacaaacaa caaatccctt gattagacgc
9721 gttatgtggc catgggactt tctgtctcgg gtgacaacct ttatgatgac cgatgtttca
9781 acgtatgccc aacaaaaggt gctgcgtgaa aaagtggaca ctgtctctga ggagcccgac
9841 gagcgaatga aagcaattaa cagactcatc atgcacacact tcgtgaaaat gttcaagcgg
9901 cgcgggctga aaccgagggt gttgacacca caagactaca tgaataatgt ccaagccaac
9961 gcagccatag gaggatggag cgaagtaatg gattggcaaa acgtgcgcga tgctttggca
10021 gatcaacgat tctgggacat ggtagataac gagagggcct tacacttgcg tggtgactgt
10081 gagctttgca tctataacac gatgggaaag aaagaaaaga agccatctgc ctttggcact
10141 gcgaaaggtt cacgcaccat ctggtatatg tggctgggta gccgttattt agagtacgag
10201 gctttaggat tcttgaacga agatcattgg gttgcacgag aaaactttcc atgtggagtc
10261 ggtggcgtcg gcgttaacta ttttggatat tacctgaagg aaatagccgg gggaggccgg
10321 tggcttatcg cagacgatgt cgcgggatgg gacacgagaa taacccaagg agatctagat
10381 gatgagctgt tcatgttaac cgagcttgcc ccaaccacat accacaagaa attgataact
10441 gcgacaatga cgttggctta taaaaacata gtggccttat tccctagaaa tcatccgatg
10501 taccgaagtg gaactgttct tgatgtgttg tctcgaacgg atcagcgtgg gtcgggccag
10561 gtgacaacat acgctttgaa cactgtgact aatggaaagt gccaggtcgg gagaacatta
10621 gaagcgtgtg gcttgctgga cgccccgctc accacaatcg actcctggct cactgccaac
10681 ttggaacgag ttcttggagc aatggtcgtt gccggagatg atgtggtagt ggcgacagac
10741 aatgaagaat tccacgagag tttgagatac ataacagcga cgtcaaagat ccgaaagaac
10801 ttaggggtga gtgagccatc gccgagattc acgagctggg aagatgttga gttttgctca
10861 caccacttcc atccactgac gttacgtgat ggccgtgtgc tgatcgcccc gtgtcgtgac
10921 caaaacgaaa ttatcggaag atcaagaatc cagaaaggcg gaatagttga catggcctcg
10981 gctgggtgct tagcgaaggc tcacgcgcag atgtgggccc tttacttctt ccatcggcga
11041 gacttacgga ttggattcgc ggccatcaca tcaattgtgc ctatcaactg ggtgccgacg
11101 ggcaggatat catggtctat ccaccagaac gcagagtgga tgacgactga ggatatgcta
11161 acggtttgga caacgtgtg gattagggac aatccgtgga tgagaggaaa agaacgagtg
11221 acttcatgga cagacatacc gtatttaccc aaaggagtgg acataaagtg cggaagccta
11281 ataggcgatt ccgaccgcgc ttcctggtca aagacgattc ccctagttgt ggagaagacc
11341 cgaaaaatcc ttgagcagga gaggggaaca ttgaagttct acaatggggtt atccattcta
11401 ggacggtatg ttcaccacgt cgatcctgtg ttcaactgaa gtgtgacgat gtaggcccgc
11461 gggagcctta gaattcaaga gcttgggaat tctagaatcc cgtttaccgc aggagggggt
11521 catatggagc aggtggctat gtatagcctg gctaaatgta tggctcctgg gggagtgacg
11581 cccctccggt tccagttcct gggtgaacag gtaaaaacca ccacgaagcg ccgcttcaac
11641 atccaagggg ggagaaatcc cgggtgctga cgccacccccg accccagtcc cacataaggc
11701 tgtgacgaaa gagccttacc ggcacgagga gtgcccaccg caaggaggag aaatcctggg
11761 cgttgacgac gccccggccc cagtctctga taggtgacca gaaccatgtc accccaaagt
11821 gttgaaagga cactgatcac cagaaatggt gagggcacac agggcttagc ccaaggtgag
11881 tgacgacacc tcccgaaatg tgtaaatagc agggtcagct ctaagcagca ggcttccacc
11941 gttaggaagc gttgctgtga gcttacttgg ctacgtct

FIG. 22 cont.

SEQ ID NO:12          PCV/ZIKA-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata aacaatgtat ggtgctaatg ttgcttcaac aacaattctg
 481 ttgaactgtg ttttcatgtt tgccaacaag ccctttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 ttttaaaaaa cttttgcgtt agtaaaacca cggagttttg gtttgctgag aatagtgcga
1021 gggttgtttt aattatttcg gagattttgg ttcgtgatga atcaggagag aggaatactc
1081 aggggtatgg ggaggttccc ccccccccct gtgaagaagg ggaacaagaa ttctgttgcc
1141 gtggccaggg tgccaccgca gcaaggagga aaagcgagag agaaaaaccg tgagaggatt
1201 aaagcgccag gagcgcgaca tggagttgcc ggaaagatga aaagtctaat gggagaattg
1261 ggctttggat ggattgattt actacgcgtt gatttggtgg aaggaattat gatgatggtt
1321 tttgttatac agcgggcttt cgcccaagtg caccggagaa ttagaggatt atcaagacgc
1381 gtcagggcat tggagaagaa gcgtgacggt cgagcggcta tgttcatttg gactatattg
1441 gcaatgttat tcggagttat gggagcggag gtcactagac gtgggagtgc atactatatg
1501 tacttggaca gaaacgatgc tggggaggcc atatcttttc caaccacatt ggggatgaat
1561 aagtgttata tacagatcat ggatcttgga cacatgtgtg atgccaccat gagctatgaa
1621 tgccctatgc tggatgaggg ggtggaacca gatgacgtcg attgttggtg caacacgacg
1681 tcaacttggg ttgtgtacgg aacctgccat cacaaaaaag gtgaagcacg gagatctaga
1741 agagctgtga cgctcccctc ccattccact aggaagctgc aaacgcggtc gcaaacctgg
1801 ttgaatcaa gagaatacac aaagcacttg attagagtcg aaaattggat attcaggaac
1861 cctggcttcg cgttagcagc agctgccatc gcttggcttt tgggaagctc aacgagccaa
1921 aaagtcatat acttggtcat gatactgctg attgccccgg catacagcat caggtgcata
1981 ggagtcagca atagggactt tgtggaaggt atgtcaggtg ggacttgggt tgatgttgtc
2041 ttggaacatg gaggttgtgt caccgtaatg gcacaggaca aaccgactgt cgacatagag
2101 ctggttacaa caacagtcag caacatggcg gaggtaagat cctactgcta tgaggcatca
2161 atatcagaca tggcttcgga cagccgctgc ccaacacaag gtgaagccta ccttgacaag
2221 caatcagaca ctcaatatgt ctgcaaaaga acgttagtgg acagaggctg gggaaatgga
2281 tgtggacttt ttggcaaagg gagcctggtg acatgcgcta gtttgcatg ctccaagaaa
2341 atgaccggga agagcatcca gccagagaat ctggagtacc ggataatgct gtcagttcat
2401 ggctcccagc acagtgggat gatcgttaat gacacaggac atgaaactga tgagaataga
2461 gcgaaggttg agataacgcc caattcacca agagccgaag ccaccctggg gggttttgga
2521 agcctaggac ttgattgtga accgaggaca ggccttgact tttcagattt gtattacttg
2581 actatgaata caagcactg gttggtccac aaggagtggt tccacgacat tccattacct
2641 tggcacgctg gggcagacac cggaactcca cactggaaca acaaagaagc actggtagag
2701 ttcaaggacg cacatgccaa aaggcaaact gtcgtggttc tagggagtca agaaggagca
2761 gttcacacgg cccttgctgg agctctggag gctgagatgg atggtgcaaa gggaaggctg
2821 tcctctggcc acttgaaatg tcgcctgaaa atggataaac ttagattgaa gggcgtgtca
2881 tactccttgt gtaccgcagc gttcacattc accaagatcc cggctgaaac actgcacggg
```

FIG. 23

```
2941 acagtcacag tggaggtaca gtacgcaggg acagatggac cttgcaaggt tccagctcag
3001 atggcggtgg acatgcaaac tctgacccca gttgggaggt tgataaccgc taaccccgta
3061 atcactgaaa gcactgagaa ctctaagatg atgctggaac ttgatccacc atttggggac
3121 tcttacattg tcataggagt cggggagaag aagatcaccc accactggca caggagtggc
3181 agcaccattg gaaaagcatt tgaagccact gtgagaggtg ccaagagaat ggcagtcttg
3241 ggagacacag cctgggactt tggatcagtt ggaggcgctc tcaactcatt gggcaagggc
3301 atccatcaaa tttttggagc agctttcaaa tcattgtttg gaggaatgtc ctggttctca
3361 caaatcctca ttggaacgtt gctgatgtgg ttgggtctga acacaaagaa tggatctatt
3421 tcccttatgt gcttggcctt aggggagtg ttgatcttct tatccacagc cgtctctgct
3481 gacttcggat gtggatttga cccagatagg aaggtagcac agtgtggttc tggctcattc
3541 gtgtggaagt cactggcccg ttggccaatg gctgatcacg ctattgagtt tgaagatagc
3601 aaagtgatgg tgacttactt gactgaccta ttgatgagaa agaacaaagt ctgcatagtg
3661 tgtgaagatg tattgcagtg tgccgcagcg cgtggagttg tcgagcagat aacgtcgatc
3721 aatggaatcc caatccatca caacatgtcg ctgtcgcatg gccgatattt cccacgtgta
3781 gtgaagaaag tacacaatgt taaggtggga aaagccatgt tgcgccttgc aatggccaca
3841 tatgcgggag cgatgcctga gagtggattg ggtgttttga agacggggta tttttcacgc
3901 ggagaagtgc aggaaacgtg ggatgataaa gttctaagag tcctaaccag cgccataaat
3961 gcagaggaag tgtgccagac ggctgtcacg ttccagtatg agttcgttcg atataaccgg
4021 aaagtctttg gatctaacat cgtgttgcga ccttcagcct ttacgagcaa agcttgccca
4081 acatatttag ctggggctgt ggtcaaaaac gacatagcaa cgtttacgga cggaatgatg
4141 tggatgcgga gccggaaagt caatgaaacg tgggaactgt ttgagttgga aacaacccaa
4201 agccaccaat gcatttggcc atacgcgtac acaatagacc tagcaacacc cacggacaag
4261 aggcttttca tgccgccaca atacggagga ccaatttcgt ttgcgaacca cgtgcctgga
4321 ttccaggtgc aagaggactt tccctggcag aaggcgaata tattaatgcg ccagggaccg
4381 gttccgggaa cgaccgtagt ccaggatcca cactgtgatg accggagcgc ggcagtgcca
4441 gttgaaccaa ctatgcaagc ttggtgctgc aagacctgtt ttgatagagg agtgaagcct
4501 ttccattttg tggttgacgg gaaattttc tatccaatgg aagtgcggcc aatgaaactg
4561 gaacaagacg ctgtggtgat tgagactgat gatggagagt tcgagaggag tgagcatgag
4621 agcttgtttg aaggcaaagc aaagtggaca tcaccgttac caatgggaga aacagccaag
4681 attcaaaatt ttttcgtgac cagcccgcca aagccggaat caagcctgct tttggtgggc
4741 gttctgattc atatgttaac aacgcgaacc cgccatcggt gggcaactcg ttgtgctgga
4801 acttggctca tctttttggt ctttgacat ccggttgtgt cttcggtgca gtcttgggcg
4861 tggctcttta tgtcagctgc cttagcaagt gtccctggtg gttcttcact ggtgatccac
4921 ttctggattg ggttgcagat atcgtcagcg cacctctttt acctggggttg gttaatgagg
4981 aaacgcctgt tgattacaga gatgtcgcga gtggcacatc tgattgccca gttgtgcagc
5041 ttcgagacat atgcgtgggc accgatcctc aaagtactgg atcacttgct gtttccactc
5101 tacactctgt cagtattcgt cgttcaccag cagtttcagg tattccacga cttgtggcta
5161 cagagcgccg tggtgatggc acacctgttg caacaccctc tcagtggttt aataaccttg
5221 agtttaagcg tcggcttgat tcagctaata gcaccaatga aaagatggtt ttgctcacca
5281 gttatatggg gagatggctt acgcgcgccg agaccacact ggacagcctt aacgtatttc
5341 atcgtgctgt atttggcagc cgctgggatg gagacagtgg gtctgcacac gtccgggatg
5401 acagtgatgc tgggcgggat gcttctgtgg gttgtcctac agttgatgcc cccgacagcc
5461 ttggaacttg tgcgcctacc gggacaaagt ctgccagacg gatgtgaaga agaagcgtca
5521 acatctctac cagaaggaat gagtgggcat tacgccccg atggagttga actcgtgaac
5581 tacacagatg cagggactgt ctccgcaaac cttgtggtat ttgttgggtg tgctggaatt
5641 atgactatga acatatacgt tgggttggtt atcacggcct tggcctgggt aacggacgcc
5701 ccgatgtgga ttccaagatt gattgatggt gctatgtccc agcgggcaaa ttcggagcta
5761 ttgctgccat ccccacctct tgagatacac aagacggaag actcgtttgg ttacatcccg
5821 gacggaacat atcacgtgtt ggctagcagc tggatgagca agaaaccagt tggtgttgga
5881 gtggtgaagg agggcgtgtt tcacacgtta caccacgtca ccaaaggagc taatgtgaca
5941 tgggcaggac gtgaggttag gatgcactct ggagatgtta ggcgggatat tgctgcctat
```

FIG. 23 cont.

```
6001 ggcgggccct ggaacatcag cgggagtctt gaagatgtcg tagtagtgaa ggccgtgaac
6061 aaggatggaa ccgtgacatg ctgccggatt acaacagcta agttggacat tgaaggaact
6121 acagtgatgg ctgttgagcg agattttggt ttcggctctt cggggtcccc catatacgct
6181 cctgatggac ggttgattgg cttgtatgga tacgggtttt actatggaac gtacttctca
6241 atagtttcaa caggagaagg agtggaggca ccaccggaag aggttgaagt ctcaacacgt
6301 gagtttgtgg actggcaccc tggaagagga aaaacgcgca cgatactcgt tgagcaggcc
6361 ctgaagcata tagctgatgg aaagaggttg ctaattttga caccaacgcg ggtcgtaaag
6421 gatgaagtgc agcgagcgat aaaggaagcc gccccgcagg cggttatcgg atcgaactta
6481 agcatttttc ggaagaacgc cgttaccttg gcatgccacg cgaccttcac gcagtatgtg
6541 atggagaagg ggatagaaag tgtgaagttt tcgaccatca ttatggacga gtgccacttt
6601 ctggacccga tgtccatcgc gtgccgcggg ataatggatt tccacaacag ccgtggaacg
6661 aaggtcatct tcatgagtgc gacgccccca ggacgagcag gaaacgctgg gtccaacttt
6721 acaatagaag acagagccat caagttcccc aaggagttga ccgcatcgtg gatcaaagac
6781 aagtcaatag gcaagaccat cgttttgtg ccaacaatta cgcaagctgt gaggctggct
6841 aaagagttgg gaggggtggc cttgacccga gatacgttca atgatgccat ggggaaggcc
6901 cggagtccgg aaacaatgtt tataatctca acagacatca gcgagatggg agccaatctc
6961 ggagtgacta ctgttatcga cacaagaact gttataaaac cattagtgtc tgacaaagga
7021 gtttcacttg aaagggttgg tgtgacccca gcttcaatca tccagcgcag gggccgagta
7081 ggtcggcggg agcccggagt atacatttat ccccttgacg tcgaaccaga ggagcagccg
7141 gaaaattggg tgtgttgggt ggaggcgcaa atgatcttag atcaattggg ctgccatccg
7201 atgagagagg agagcgaatt tttccgccca caaggcacgt accggattga cgacgtagag
7261 cagcggaggt ttctggggtt gatcaaggaa aaactgccaa tttggcttgc ttggacttgg
7321 gccagctcac atgcgaacaa acatcagatg ctatttcagg gaaacgcccc caacactgga
7381 cgaacattaa aaataaagac gccatccgga tctcacattt acgccccaaa ggtgacagat
7441 gataggtttg aaaaggagcc agaaattgtg aaagtggcgg ccatcggatt cttcctaaag
7501 cagagatcac tatacttcga cttacctgga ttattgaccg gattgtacac ggtgttgaca
7561 acggctgggc tcgatgccct tggaaattcg ttcaaacgct ctgtggacac ccttcacgac
7621 atcggaaatg cggtggaagg agagtttctct gctatacaaa tgggacggat tttacagatg
7681 tggtctgcgt tgtttatcgg ggtgactttg ggagttgtgc tgatgggagc cggatttgtt
7741 gtggtgaagg cttttagagg attgtttgga acccgccaac aacacacaac tgtgtgcgtg
7801 tcggagggcg gaagtttcca aaaagttgcc acggttctaa tgagcgttgg accattgtgc
7861 gccgtttttg gtggcattcc ctctatattc gtcttcattg tgaccgttgc cctgttgatt
7921 gtgctgtgtg tgggcggagg tggctctcaa cgtggtgtgc ttgattcgga tctaatacgc
7981 tgggtcatgg tgttggccat gatgacaatc ggagtgactg cgtgggagtt ggagctatta
8041 ccaaacgtga aagagatgt tatacagttg actcgatacc tgtttgctag caatcctgcc
8101 gttgttggag ctgtgtttaa cgccgggaat atcggattgg gagtctctct gccagggacc
8161 ctcatgatga gctacgccgc gagcggaacg ctggcccccc ttattggagc gtgggccgaa
8221 ggaaattct taggaaagct ctttggtagc gaagtgcttc cagctcaggc tataggcgga
8281 tttcaagtga cagctatccc gtggggatct atggtgccgg ttatcgctgg ttgctttcta
8341 gcgacaaaca ctctttcgaa agtgtttggt gctggaatta caactgtgtt tctcatacta
8401 ctctacttcg acaagaaaca tgcattcacg aacaaggctg ttaaggtttt gttggcgcgg
8461 acaaacagaa gggacatgga ggaagaaatc acaacaaggg acgcggagtc gcgggctcgc
8521 caactgtttt atggcctaca actggccgta tcgttgctgt gggttctctc acatcctgtg
8581 ttgaaaaact tcgttccatt cttttgctgtg tgcgggtaca cattcctgtc gctcttgagg
8641 ccaaatcatc aactacatgc tgcgttggat tatacattgg tagtcctgct cttgcaggta
8701 gttgaacctg ggaacatcat gtacgtcggc ggatgcgttt tgttatggta tgttttaaac
8761 cctaccagat tgggcgtgcg ctcgctggtg aagagtgaca ccggaggttt aggcttccgt
8821 tggaagaaag cgttgaattc acttagtgag aggcagtttg ccatctacaa agtcagaggc
8881 gtgaatgaaa ctgataaagg agcctacgtg tcgcgaggtg gtttaaaaat gaacgagatt
8941 atcaacaagc atgcgtggga acctcgagga gttgtcgttg acctgggatg tggacgagga
9001 ggttggtccc agcgcttggt gatggattac cgcgtcgcgt aagtaagagg atacacactt
```

FIG. 23 cont.

9061 ggaggcaaag aacgtgagaa tccccaaccg ttccaaacga aaggatataa cttggcgaat
9121 ttgaaggctg gagttgacgt ctataaaatg gagccagtga attgtaacac cataatttgc
9181 gacataggtg agagtgaccc gcgtcctgaa gttgaaaaaa ctcgaacgct gaaggttttg
9241 ggaatgctgg agaaatggct ggaagtcaat ccaaacgcct cttttgctg caaagtgcta
9301 tcaccttatc acttggacgt gcttcgaaag ttagagtcgc tgcaacacaa gtataacggg
9361 cggctggttc gactgtctta cagtcggaac tcaacagcag aaatgtatta tgtgtcagga
9421 aagagggcaa acgtggtggc aagcgtgtac ttcatgcttg ggtcgctggt aggtaggctg
9481 cggagacatg agccatcaat catcgacccc ccaccggttc tagagatggg aaccagaagc
9541 gatccgcgag caaaggccaa agcgcaagac ttcgagatga tccgaagaag agtggaacga
9601 ctacgaggag aaaatcggaa aacatggttt gtggacaacg aacatccata tgtgtcattt
9661 aactaccatg gatccttcgt gactgatgag gtgacagcgg gcggacaaac aacaaatccc
9721 ttgattagac gcgttatgtg gccatgggac tttctgtctc gggtgacaac ctttatgatg
9781 accgatgttt caacgtatgc ccaacaaaag gtgctgcgtg aaaaagtgga cactgtctct
9841 gaggagcccg acgagcgaat gaaagcaatt aacagactca tcatgacaca cttcgtgaaa
9901 atgttcaagc ggcgcgggct gaaaccgagg gtgttgacac cacaagacta catgaataat
9961 gtccaagcca acgcagccat aggaggatgg agcgaagtaa tggattggca aaacgtgcgc
10021 gatgctttgg cagatcaacg attctgggac atggtagata acgagagggc cttcacttg
10081 cgtggtgact gtgagctttg catctataac acgatgggaa agaaagaaaa gaagccatct
10141 gccttttggca ctgcgaaagg ttcacgcacc atctggtata tgtggctggg tagccgttat
10201 ttagagtacg aggcttagg attcttgaac gaagatcatt gggttgcacg agaaaacttt
10261 ccatgtggag tcggtggcgt cggcgttaac tattttggat attacctgaa ggaaatagcc
10321 gggggaggcc ggtggcttat cgcagacgat gtcgcgggat gggacacgag aataacccaa
10381 ggagatctag atgatgagct gttcatgtta accgagcttg ccccaaccac ataccacaag
10441 aaattgataa ctgcgacaat gacgttggct tataaaaaca tagtggcctt attcctaga
10501 aatcatccga tgtaccgaag tggaactgtt cttgatgtgt tgtctcgaac ggatcagcgt
10561 gggtcgggcc aggtgacaac atacgctttg aacactgtga ctaatggaaa gtgccaggtc
10621 gggagaacat tagaagcgtg tggcttgctg gacgccccgc tcaccacaat cgactcctgg
10681 ctcactgcca acttggaacg agttcttgga gcaatggtcg ttgccggaga tgatgtggta
10741 gtggcgacag acaatgaaga attccacacg agtttgagat acataacagc gacgtcaaag
10801 atccgaaaga acttaggggt gagtgagcca tcgccgagat tcacgagctg ggaagatgtt
10861 gagttttgct cacaccactt ccatccactg acgttacgtg atggccgtgt gctgatcgcc
10921 ccgtgtcgtg accaaaacga aattatcgga agatcaagaa tccagaaagg cggaatagtt
10981 gacatggcct cggctgggtg cttagcgaag gctcacgcgc agatgtgggc cctttacttc
11041 ttccatcggc gagacttacg gattggattc gcggccatca catcaattgt gcctatcaac
11101 tgggtgccga cgggcaggat atcatggtct atccaccaga acgcagagtg gatgacgact
11161 gaggatatgc taacggtttg gaacaacgtg tggattaggg acaatccgtg gatgagagga
11221 aaagaacgag tgacttcatg gacagacata ccgtatttac ccaaaggagt ggacataaag
11281 tgcggaagcc taataggcga ttccgaccgc gcttcctggt caaagacgat tccctagtt
11341 gtggagaaga cccgaaaaat ccttgagcag gagaggggaa cattgaagtt ctacaatggg
11401 ttatccattc taggacggta tgttcaccac gtcgatcctg tgttcaactg aagtgtgacg
11461 atgtaggccc gcgggagcct tagaattcaa gagcttggga attctagaat cccgtttacc
11521 gcaggagggg gtcatatgga gcaggtggct atgtatagcc tggctaaatg tatggctcct
11581 gggggagtga cgcccctccg gttccagttc ctgggtgaac aggtaaaaac caccacgaag
11641 cgccgcttca acatcgcaag ggggagaaat cccgggtgct gacgccaccc cgaccccagt
11701 cccacataag gctgtgacga aagagcctta ccggcacgag gagtgcccac cgcaaggagg
11761 agaaatcctg ggcgttgacg acgccccggc cccagtctct gataggtgac cagaaccatg
11821 tcaccccaaa gtgttgaaag gacactgatc accagaaatg gtgagggcac acagggctta
11881 gcccaaggtg agtgacgaca cctcccgaaa tgtgtaaata gcagggtcag ctctaagcag
11941 caggcttcca ccgttaggaa gcgttgctgt gagcttactt ggctacgtct

FIG. 23 cont.

SEQ ID NO:13        PCV/DENV2-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttttata ctcggtggcc tccccaccac
 541 caacttttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 ttttaaaaaa cttttgcgtt agtaaaacca cggagttttg gtttgctgag aatagtgcga
1021 gggttgtttt aattatttcg gagattttgg ttcgtgatga atcaggagag aggaatactc
1081 aggggtatgg ggaggttccc ccccccccct gtgaagaagg ggaacaagaa ttctgttgcc
1141 gtggccaggg tgccaccgca gcaaggagga aaagcgagag agaaaaaccg tgagaggatt
1201 aaagcgccag gagcgcgaca tggagttgcc ggaaagatga aaagtctaat gggagaattg
1261 ggctttggat ggattgattt actacgcgtt gatttggtgg aaggaattat gatgatggtt
1321 tttgttatac agcgggcttt cgcccaagtg caccggagaa ttagaggatt atcaagacgc
1381 gtcagggcat tggagaagaa gcgtgacggt cgagcggcta tgttcatttg gactatattg
1441 gcaatgttat tcggagttat gggatttcat ctgaccacac gcaacggaga accacacatg
1501 atcgtcagta gacaagaaaa agggaaaagc cttctgttta agacaaagga cggcacgaac
1561 atgtgtaccc tcatggccat ggaccttggt gagttgtgtg aagacacaat cacgtataaa
1621 tgtccttttc tcaagcagaa cgaaccagaa gacatagatt gttggtgcaa ctccacgtcc
1681 acatgggtaa cttatgggac atgtaccacc acaggagagc acagaagaga aaaagatca
1741 gtggcgcttg ttccacacgt gggaatggga ttggagacac gaactgaaac atggatgtca
1801 tcagaagggg cctggaaaca tgcccagaga attgaaactt ggattctgag acatccaggc
1861 tttaccataa tggccgcaat cctggcatac accataggaa cgacgcattt ccaaagagtc
1921 ctgatattca tcctactgac agccatcgct ccttcaatga caatgcgctg cataggaata
1981 tcaaataggg actttgtgga aggagtgtca ggagggagtt gggttgacat agttttagaa
2041 catggaagtt gtgtgacgac gatggcaaaa aataaaccaa cactggactt tgaactgata
2101 aaaacagaag ccaaacaacc cgccaccttta aggaagtact gtatagaggc taaactgacc
2161 aacacgacaa cagactcgcg ctgcccaaca caaggggaac ccaccctgaa tgaagagcag
2221 gacaaaaggt tgtctgcaa acattccatg gtagacagag gatggggaaa tggatgtgga
2281 ttatttggaa aaggaggcat cgtgacctgt gctatgttca catgcaaaaa gaacatggaa
2341 ggaaaaattg tgcagccaga aaacctggaa tacactgtcg tgataacacc tcattcaggg
2401 gaagaacatg cagtcggaaa tgacacagga aaacatggta agaagtcaa gataacacca
2461 cagagctcca tcacagaggc ggaactgaca ggctatggca ctgttacgat ggagtgctct
2521 ccaagaacgg gcctcgactt caatgagatg gtgttgctgc aaatgaaaga caaagcttgg
2581 ctggtgcaca gacaatggtt cctagaccta ccgttgccat ggctgcccgg agcagacaca
2641 caaggatcaa attggataca gaaagagaca ctggtcacct tcaaaaatcc catgcgaaa
2701 aaacaggatg ttgttgtctt aggatcccaa gagggggcca tgcatacagc actcacaggg
2761 gctacggaaa tccagatgtc atcaggaaac ctgctgttca caggacatct caagtgcagg
2821 ctgagaatgg acaaattaca acttaaaggg atgtcatact ccatgtgcac aggaaagttt
2881 aaaattgtga aggaaatagc agaaacacaa catgaacaa tagtcattag agtacaatat
2941 gaaggagacg gctctccatg caagatcccc tttgagataa tggatctgga aaaaagacat
```

FIG. 24

3001 gttttgggcc gcctgatcac agtcaaccca attgtaacag aaaaggacag tccagtcaac
3061 atagaagcag aacctccatt cggagacagc tacatcatca taggagtgga accaggacaa
3121 ttgaagctgg actggttcaa gaaaggaagt tccatcggcc aaatgtttga gacaacaatg
3181 aggggagcga aaagaatggc cattttgggc gacacagcct gggattttgg atctctggga
3241 ggagtgttca catcaatagg aaaggctctc caccaggttt ttggagcaat ctacggggct
3301 gctttcagtg gggtctcatg gactatgaag atcctcatag gagttatcat cacatggata
3361 ggaatgaact cacgtagcac atcactgtct gtgtcactgg tattagtggg aatcgtgaca
3421 ctgtacttgg gagttatggt gcaggccgac ttcggatgtg gatttgaccc agataggaag
3481 gtagcacagt gtggttctgg ctcattcgtg tggaagtcac tggcccgttg gccaatggct
3541 gatcacgcta ttgagtttga agatagcaaa gtgatggtga cttacttgac tgacctattg
3601 atgagaaaga acaaagtctg catagtgtgt gaagatgtat tgcagtgtgc cgcagcgcgt
3661 ggagttgtcg agcagataac gtcgatcaat ggaatcccaa tccatacaca catgtcgctg
3721 tcgcatggcc gatatttccc acgtgtagtg aagaaagtac acaatgttaa ggtgggaaaa
3781 gccatgttgc gccttgcaat ggccacatat gcgggagcga tgcctgagag tggattgggt
3841 gttttgaaga cggggtattt ttcacgcgga gaagtgcagg aaacgtggga tgataaagtt
3901 ctaagagtcc taaccagcgc cataaatgca gaggaagtgt gccagacggc tgtcacgttc
3961 cagtatgagt tcgttcgata taaccggaaa gtctttggat ctaacatcgt gttgcgacct
4021 tcagccttta cgagcaaagc ttgcccaaca tatttagctg gggctgtggt caaaaacgac
4081 atagcaacgt ttacggacgg aatgatgtgg atgcggagcc ggaaagtcaa tgaaacgtgg
4141 gaactgtttg agttggaaac aacccaaagc caccaatgca tttggccata cgcgtacaca
4201 atagacctag caacacccac ggacaagagg cttttcatgc cgccacaata cggaggacca
4261 atttcgtttg cgaaccacgt gcctggattc caggtgcaag aggactttcc ctggcagaag
4321 gcgaatatat taatgcgcca gggaccggtt ccgggaacga ccgtagtcca ggatccacac
4381 tgtgatgacc ggagcgcggc agtgccagtt gaaccaacta tgcaagcttg gtgctgcaag
4441 acctgttttg atagaggagt gaagcctttc cattttgtgg ttgacgggaa attttctat
4501 ccaatggaag tgcggccaat gaaactggaa caagacgctg tggtgattga gactgatgat
4561 ggagagttcg agaggagtga gcatgagagc ttgtttgaag gcaaagcaaa gtggacatca
4621 ccgttaccaa tgggagaaac agccaagatt caaaattttt tcgtgaccag cccgccaaag
4681 ccggaatcaa gcctgctttt ggtgggcgtt ctgattcata tgttaacaac gcgaacccgc
4741 catcggtggg caactcgttg tgctggaact tggctcatct ttttggtctt tggacatccg
4801 gttgtgtctt cggtgcagtc ttgggcgtgg ctctttatgt cagctgcctt agcaagtgtc
4861 cctggtggtt cttcactggt gatccacttc tggattgggt tgcagatatc gtcagcgcac
4921 ctcttttacc tgggttggtt aatgaggaaa cgcctgttga ttacagagat gtcgcgagtg
4981 gcacatctga ttgcccagtt gtgcagcttc gagacatatg cgtgggcacc gatcctcaaa
5041 gtactggatc acttgctgtt tccactctac actctgtcag tattcgtcgt tcaccagcag
5101 tttcaggtat tccacgactt gtggctacag agcgccgtgg tgatggcaca cctgttgcaa
5161 caccctctca gtggtttaat aaccttgagt ttaagcgtcg gcttgattca gctaatagca
5221 ccaatgaaaa gatggttttg ctcaccagtt atatgggag atggcttacg cgcgccgaga
5281 ccacactgga cagccttaac gtatttcatc gtgctgtatt tggcagccgc tgggatggag
5341 acagtgggtc tgcacacgtc cgggatgaca gtgatgctgg gcgggatgct tctgtgggtt
5401 gtcctacagt tgatgccccc gacagccttg gaacttgtgc gcctaccggg acaaagtctg
5461 ccagacggat gtgaagaaga agcgtcaaca tctctaccag aaggaatgag tgggcattac
5521 gcccccgatg gagttgaact cgtgaactac acagatgcag gactgtctc cgcaaaccct
5581 gtggtatttg ttgggtgtgc tggaattatg actatgaaca tatacgttgg gttggttatc
5641 acggccttgg cctgggtaac ggacgccccg atgtggattc caagattgat tgatggtgct
5701 atgtcccagc gggcaaattc ggagctattg ctgccatccc cacctcttga gatacacaag
5761 acggaagact cgtttggtta catcccggac ggaacatatc acgtgttggc tagcagctgg
5821 atgagcaaga accagttgg tgttggagtg gtgaaggagg gcgtgtttca cacgttacac
5881 cacgtcacca aaggagctaa tgtgacatgg gcaggacgtg aggttaggat gcactctgga
5941 gatgttaggc gggatattgc tgcctatggc gggccctgga acatcagcgg gagtctttga
6001 gatgtcgtag tagtgaaggc cgtgaacaag gatggaaccg tgacatgctg ccggattaca

FIG. 24 cont.

```
6061 acagctaagt tggacattga aggaactaca gtgatggctg ttgagcgaga ttttggtttc
6121 ggctcttcgg ggtcccccat atacgctcct gatggacggt tgattggctt gtatggatac
6181 gggttttact atggaacgta cttctcaata gtttcaacag gagaaggagt ggaggcacca
6241 ccggaagagg ttgaagtctc aacacgtgag tttgtggact ggcaccctgg aagaggaaaa
6301 acgcgcacga tactcgttga gcaggccctg aagcatatag ctgatggaaa gaggttgcta
6361 attttgacac caacgcgggt cgtaaaggat gaagtgcagc gagcgataaa ggaagccgcc
6421 ccgcaggcgg ttatcggatc gaacttaagc attttcgga agaacgccgt taccttggca
6481 tgccacgcga ccttcacgca gtatgtgatg gagaagggga tagaaagtgt gaagttttcg
6541 accatcatta tggacgagtg ccactttctg gacccgatgt ccatcgcgtg ccgcgggata
6601 atggatttcc acaacagccg tggaacgaag gtcatcttca tgagtgcgac gcccccagga
6661 cgagcaggaa acgctgggtc caactttaca atagaagaca gagccatcaa gttccccaag
6721 gagttgaccg catcgtggat caaagacaag tcaataggca agaccatcgt ttttgtgcca
6781 acaattacgc aagctgtgag gctggctaaa gagttgggag gggtggcctt gacccgagat
6841 acgttcaatg atgccatggg gaaggcccgg agtccggaaa caatgtttat aatctcaaca
6901 gacatcagcg agatgggagc caatctcgga gtgactactg ttatcgacac aagaactgtt
6961 ataaaaccat tagtgtctga caaaggagtt tcacttgaaa gggttggtgt gaccccagct
7021 tcaatcatcc agcgcagggg ccgagtaggt cggcgggagc ccggagtata catttatccc
7081 cttgacgtcg aaccagagga gcagccggaa aattgggtgt gttgggtgga ggcgcaaatg
7141 atcttagatc aattgggctg ccatccgatg agagaggaga gcgaattttt ccgcccacaa
7201 ggcacgtacc ggattgacga cgtagagcag cggaggtttc tggggttgat caaggaaaaa
7261 ctgccaattt ggcttgcttg gacttgggcc agctcacatg cgaacaaaca tcagatgcta
7321 tttcagggaa acgcccccaa cactggacga acattaaaaa taaagacgcc atccggatct
7381 cacatttacg ccccaaaggt gacagatgat aggtttgaaa aggagccaga aattgtgaaa
7441 gtggcggcca tcggattctt cctaaagcag agatcactat acttcgactt acctggatta
7501 ttgaccggat tgtacacggt gttgacaacg gctgggctcg atgcccttgg aaattcgttc
7561 aaacgctctg tggacaccct tcacgacatc ggaaatgcgg tggaaggaga gttttctgct
7621 atacaaatgg gacggatttt acagatgtgg tctgcgttgt ttatcggggt gactttggga
7681 gttgtgctga tgggagccgg atttgttgtg gtgaaggctt ttagaggatt gtttggaacc
7741 cgccaacaac acacaactgt gtgcgtgtcg gagggcggaa gtttccaaaa agttgccacg
7801 gttctaatga gcgttggacc attgtgcgcc gtttttggtg gcattccctc tatattcgtc
7861 ttcattgtga ccgttgccct gttgattgtg ctgtgtgtgg gcggaggtgg ctctcaacgt
7921 ggtgtgcttg attcggatct aatacgctgg gtcatggtgt tggccatgat gacaatcgga
7981 gtgactgcgt gggagttgga gctattacca aacgtgagaa gagatgttat acagttgact
8041 cgatacctgt ttgctagcaa tcctgccgtt gttggagctg tgtttaacgc cgggaatatc
8101 ggattgggag tctctctgcc agggaccctc atgatgagct acgccgcgag cggaacgctg
8161 gcccccctta ttggagcgtg ggccgaagga aatttcttag gaaagctctt tggtagcgaa
8221 gtgcttccag ctcaggctat aggcggattt caagtgacag ctatcccgtg gggatctatg
8281 gtgccggtta tcgctggttg ctttctagcg acaaacactc tttcgaaagt gtttggtgct
8341 ggaattacaa ctgtgtttct catactactc tacttcgaca gaaacatgc attcacgaac
8401 aaggctgtta aggttttgtt ggcgcggaca aacagaaggg acatggagga agaaatcaca
8461 acaagggacg cggagtcgcg ggctcgccaa ctgttttatg gcctacaact ggccgtatcg
8521 ttgctgtggg ttctctcaca tcctgtgttg gaaaacttcg ttccattctt tgctgtgtgc
8581 gggtacacat tcctgtcgct cttgaggcca aatcatcaac tacatgctgc gttggattat
8641 acattggtag tcctgctctt gcaggtagtt gaacctggga acatcatgta cgtcggcgga
8701 tgcgttttgt tatggtatgt tttaaaccct accagattgg gcgtgcgctc gctggtgaag
8761 agtgacaccg gaggtttagg cttccgttgg aagaaagcgt tgaattcact tagtgagagg
8821 cagtttgcca tctacaaagt cagaggcgtg aatgaaacta ataaaggagc ctacgtgtcg
8881 cgaggtggtt aaaaatgaa cgagattatc aacaagcatg cgtgggaacc tcgaggagtt
8941 gtcgttgacc tgggatgtgg acgaggaggt tggtcccagc gcttggtgat ggattaccgc
9001 gtcgctgaag taagaggata cacacttgga ggcaaagaac gtgagaatcc ccaaccgttc
9061 caaacgaaag gatataactt ggcgaatttg aaggctggag ttgacgtcta taaaatggag
```

FIG. 24 cont.

```
9121 ccagtgaatt gtaacaccat aatttgcgac ataggtgaga gtgacccgcg tcctgaagtt
9181 gaaaaaactc gaacgctgaa ggttttggga atgctggaga aatggctgga agtcaatcca
9241 aacgcctctt tttgctgcaa agtgctatca ccttatcact tggacgtgct tcgaaagtta
9301 gagtcgctgc aacacaagta taacgggcgg ctggttcgac tgtcttacag tcggaactca
9361 acagcagaaa tgtattatgt gtcaggaaag agggcaaacg tggtggcaag cgtgtacttc
9421 atgcttgggt cgctggtagg taggctgcgg agacatgagc catcaatcat cgaccccca
9481 ccggttctag agatgggaac cagaagcgat ccgcgagcaa aggccaaagc gcaagacttc
9541 gagatgatcc gaagaagagt ggaacgacta cgaggagaaa atcggaaaac atggtttgtg
9601 gacaacgaac atccatatgt gtcatttaac taccatggat ccttcgtgac tgatgaggtg
9661 acagcgggcg gacaaacaac aaatcccttg attagacgcg ttatgtggcc atgggacttt
9721 ctgtctcggg tgacaacctt tatgatgacc gatgtttcaa cgtatgccca acaaaaggtg
9781 ctgcgtgaaa aagtggacac tgtctctgag gagcccgacg agcgaatgaa agcaattaac
9841 agactcatca tgacacactt cgtgaaaatg ttcaagcggc gcgggctgaa accgagggtg
9901 ttgacaccac aagactacat gaataatgtc caagccaacg cagccatagg aggatggagc
9961 gaagtaatgg attggcaaaa cgtgcgcgat gctttggcag atcaacgatt ctgggacatg
10021 gtagataacg agagggcctt acacttgcgt ggtgactgtg agctttgcat ctataacacg
10081 atgggaaaga aagaaaagaa gccatctgcc tttggcactg cgaaaggttc acgcaccatc
10141 tggtatatgt ggctgggtag ccgttattta gagtacgagg ctttaggatt cttgaacgaa
10201 gatcattggg ttgcacgaga aaactttcca tgtggagtcg gtggcgtcgg cgttaactat
10261 tttggatatt acctgaagga aatagccggg ggaggccggt ggcttatcgc agacgatgtc
10321 gcgggatggg acacgagaat aacccaagga gatctagatg atgagctgtt catgttaacc
10381 gagcttgccc caaccacata ccacaagaaa ttgataactg cgacaatgac gttggcttat
10441 aaaaacatag tggccttatt ccctagaaat catccgatgt accgaagtgg aactgttctt
10501 gatgtgttgt ctcgaacgga tcagcgtggg tcgggccagg tgacaacata cgctttgaac
10561 actgtgacta atggaaagtg ccaggtcggg agaacattag aagcgtgtgg cttgctggac
10621 gcccccgctca ccacaatcga ctcctggctc actgccaact tggaacgagt tcttggagca
10681 atggtcgttg ccggagatga tgtggtagtg gcgacagaca atgaagaatt ccacacgagt
10741 ttgagataca taacagcgac gtcaaagatc cgaaagaact tagggtgag tgagccatcg
10801 ccgagattca cgagctggga agatgttgag ttttgctcac accacttcca tccactgacg
10861 ttacgtgatg gccgtgtgct gatcgccccg tgtcgtgacc aaaacgaaat tatcggaaga
10921 tcaagaatcc agaaaggcgg aatagttgac atggcctcgg ctgggtgctt agcgaaggct
10981 cacgcgcaga tgtgggccct ttacttcttc catcggcgag acttacggat tggattcgcg
11041 gccatcacat caattgtgcc tatcaactgg gtgccgacgg gcaggatatc atggtctatc
11101 caccagaacg cagagtggat gacgactgag gatatgctaa cggtttggaa caacgtgtgg
11161 attagggaca atccgtggat gagaggaaaa gaacgagtga cttcatggac agacataccg
11221 tatttaccca aaggagtgga cataaagtgc ggaagcctaa taggcgattc cgaccgcgct
11281 tcctggtcaa agacgattcc cctagttgtg gagaagaccc gaaaaatcct tgagcaggag
11341 aggggaacat tgaagttcta caatgggtta tccattctag gacggtatgt tcaccacgtc
11401 gatcctgtgt tcaactgaag tgtgacgatg taggcccgcg ggagccttag aattcaagag
11461 cttgggaatt ctagaatccc gtttaccgca ggagggggtc atatggagca ggtggctatg
11521 tatagcctgg ctaaatgtat ggctcctggg ggagtgacgc ccctccggtt ccagttcctg
11581 ggtgaacagg taaaaaccac cacgaagcgc cgcttcaaca tcgcaagggg gagaaatccc
11641 gggtgctgac gccaccccga ccccagtccc acataaggct gtgacgaaag agccttaccg
11701 gcacgaggag tgcccaccgc aaggaggaga aatcctgggc gttgacgacg ccccggcccc
11761 agtctctgat aggtgaccag aaccatgtca ccccaaagtg ttgaaaggac actgatcacc
11821 agaaatggtg agggcacaca gggcttagcc caaggtgagt gacgacacct cccgaaatgt
11881 gtaaatagca gggtcagctc taagcagcag gcttccaccg ttaggaagcg ttgctgtgag
11941 cttacttggc tacgtct
```

FIG. 24 cont.

SEQ ID NO:14             BgV/WNV$_{KUN}$-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata tggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttttata ctcggtggcc tccccaccac
 541 caacttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaaccg
 961 taaaatccgt acgcttgttt tggcacacta gtttgtgaca taaggctttt gtcgcgcgta
1021 ttgggtttaa ctttttttcg agaaatcgag aggtaagaag aattgaaaga cattatgtct
1081 aacccttccg tcaggagggg tgtcaatgtg atggcggctc agaaaaaacg agtcgcccaa
1141 aaaataaaat caatgaggaa gggaacccag agcatcagca atggagttag gggtttcatc
1201 ctctttttca tatcccaaat cttctgggca cgtaagatca cgcccagagt gaaaggattg
1261 tggaaaaaac tagacaaatt tcaggcaatg aaggttttga aagggctaag gaacatcatc
1321 aatggattga tgagatcggt cgctgggaaa aagaaacgcc gtggagggaa taccgtgcca
1381 ttcttagtga tgatgatggt agcaacaaca tgggccgtca ctctctccaa cttttcaaggg
1441 aaggtgatga tgacggtgaa cgctactgac gtcacagaca ttatcacgat accaacggcc
1501 gctggaaaga acctgtgcat tgtcagagct atggatgtgg ggcacatgtg tgatgatact
1561 atcacctatg aatgtccagt gttgtcggcc ggaaatgatc cagaagacat tgactgctgg
1621 tgcacgaagt tagcagtcta cgttaggtat ggaagatgca ccaagacacg acactcaaga
1681 cgcagcagaa ggtcactaac agtgcagacg catggagaga gcaccctatc gaacaaaaag
1741 ggggcctgga tggacagcac caaggctaca aggtacttgg taaaaacaga atcatggatc
1801 ttgagaaacc ctggatatgc cttggtggca gctgtcattg gatggatgct cggaagcaac
1861 accatgcagc gtgtcgtgtt tgccgtgtta ctgctttttgg tagctccagc ttacagcttt
1921 aactgtcttg gaatgagcaa cagagatttc ctggagggag tgtccggagc aacatggtg
1981 gacttggtcc ttgaaggtga cagctgtgtg accattatgt ccaaggacaa gcccaccatc
2041 gatgtgaaga tgatgaacat ggaggccgct aacttagcag aagtccgcag ttattgctac
2101 ttagccactg tcagtgaact ctccaccaag gctgcgtgcc caaccatggg ggaagcccat
2161 aatgacaagc gggctgaccc atcttttgtg tgcaaacaag gagtagtgga tagaggttgg
2221 ggcaatgggt gcggactttt tggtaaagga agcatcgaca catgcgccaa atttgcctgt
2281 tcaaccaagg caacgggaag gactatctta aaggagaaca ttaagtatga ggtggctatc
2341 tttgtgcatg gaccaactac cgtggaatcg catgggaact acttcacgca aaccggagct
2401 gctcaggctg ggagatttag tatcaccccc gcggcaccct cttacactct taagctcgga
2461 gagtatggag aagtaacagt ggactgtgaa ccacgctcag ggatagacac cagtgcatac
2521 tatgtgatga ctgtcgggac aaagacttc ttggtccacc gtgagtggtt tatggacctc
2581 aacctcccct ggagcagtgc tgaaagtaat gtttggagga acagagagac gctaatggag
2641 tttgaagaac cacacgctac gaagcaatct gtgatagcat tgggctctca gagggagcc
2701 ctgcatcaag ctctggcagg agccattcct gtggaatttt caagcaacac tgtcaagctg
2761 acgtcaggcc acctgaagtg tagggtgaag atggaaaaat tgcagctgaa ggggacaact
2821 tatggcgtct gttcaaaggc cttcagattc cttgggactc ccgcagacac gggccatggt
2881 actgtggtac tggaactgca gtacacaggc acggatggac cctgcaagat acccattca
2941 tcagtagctt cattgaatga cctaacgcca gtgggcaggt tagttaccgt caacccctt
```

FIG. 25

3001 gtctccgtgt caacggccaa tgctaaagtc ctgattgagt tggaaccacc ctttggagat
3061 tcgtacatag tggtgggaag aggagagcaa cagatcaacc atcactggca caagtctgga
3121 agtagcattg gcaaagcttt cacagccacc ctcaagggag ctcagagact agcagctctg
3181 ggagacacag cttgggactt tggatcggtt ggaggagtgt ttacctccgt gggaaaggct
3241 gtccatcaag tatttggtgg agcattccgc tcattgtttg gaggcatgtc ttggataact
3301 cagggtctgc tgggggccct cctattgtgg atgggtatta acgtcgtga tagatccata
3361 gccctcacgt tcctcgcggt tggaggagtt ctgctctttc tctccgtgaa cgtgcatgct
3421 gagtacggtt gctcattgga cttccaaagg aaagaactga agtgcggcga tggagttttc
3481 gtgttcaatg atgccaatga ttggttgacc aagtacagat atcatcctga agacccacga
3541 acattggctt ctctggtcaa ggcttcatat aaggccggac ggtgtgggct tggatcagtt
3601 gacaacatgg aacataagat gtgggtgtcc ctggaaaatg agttgaatgc catctttgag
3661 gaaaaccaag aaaatatctc agtggtagtg aaggagagta atggaatata ccccaaagga
3721 aattatccat tcactggcac tccagaaaag ctgaaatatg gatggaaaac atgggggaag
3781 aaattggtat ttgccccggt tttgagtaac aacacctttg taatagatgg aactcccgat
3841 gattgtcctt acagcaacag agtttggaat tcatttgaga ttgatgagtt cggagcaggt
3901 ttgactcata ccagggtgtt tttgaaacaa agactggaaa gaaaagaaga gtgtgacaat
3961 gcacttttag gagctgcagc caaaggggac gtggcagtcc atggggatcc caacttctgg
4021 atggcctcaa acaaaactgg agaagtgtgg cagatcaatg aattaatgtc actaaacctc
4081 aagcactgca catggcccctt gtctcatacg ttgcatggca atggagttct ggaatcagac
4141 atgttcgttc cgaaaagcat tggaggaccg gttagtcacc acaacttcat taaaggctac
4201 aaatctcagg taaatggacc ttgggcatca gtgcctctag aaatgcatcg gagagagtgc
4261 cctgacacag tggttcaaat agatcagaac tgcagcggga gaggcaagtc cacacggagc
4321 actacaaagg aagggaaaat aatccgggat tggtgttgtc gaaactgcac gctgccccct
4381 gttagctttg atggtcctga tggatgctgg tatgctatgg agattagacc gcagaagatg
4441 aatgaaaaac atttggtcac ttcatgggta agtgccggtg acgggatgga aaatggtaac
4501 attggattgg tggctctctt tgtgtgcttt gacatgttct tgaagaacaa gaacacccga
4561 aagattagct tggttggagc cttgtgtcta ttgggcgcaa tgatccttgg gaatgttgga
4621 tttgttgatc taataaaatt catgattgtg gttggtgaac atttccgctc cttcaaccat
4681 ggaggtgacg tctcctactt ggtcctgacc gctgtctttg acatcaggcc agccctgctc
4741 tgcggctttg tgctgcgcaa gaaatggagt cctagtgaga gagtagtcat ggccattgga
4801 atgatgctcc tgcaaacggt gtgtgggat tggactcaga catcttggtg ggaatggctg
4861 gatgctgttg gattggggct cttgatcctc aatgcagtag ctttacaaag atggaaaccg
4921 gccattttgg tcttgctgac aatgttgact ccgctgaata tgcgagtaat tcaaggtgct
4981 gcaggggag tgtgtggcgt tatggtggcc atgtctttgt ggaaaacaga aggaagaagt
5041 ctccgtaaga gttacctgcc agtcattggc tatgttgctt cggcttttgg atgggggtat
5101 tcatggatca tggcagtgta catcatgtgg gcaacccatg tgtcaaggag atcttggcct
5161 gtaggagagc tggcagcagc aattggactt ttgggagctg caatgggaat ggcatccaca
5221 aaggatggag ccatggtcat gccaatagct gtgctcggat taatcatggt gatcatagga
5281 atgacaggca aatgcgatgg aatggagatt cgcaaagttg ggtgtgtctc gtgggaagac
5341 tccgctgaga tcagtggttc aagctccagg tatgacgtgg ctcttagtga tggcggagaa
5401 ttccagctgt tagagaattc gcggccccccc tggaatcaca tcattttcct cacccctggga
5461 atgctggcgt cagcagtgca tccaatagta ctgggtgtgg tcatacttgc ctgggggtgg
5521 tttgcaggca aaaagccagc gcagtggagtt ttgtgggacg tgcctgttgc tccaaaagtt
5581 gaggaccatg gacccccttga ggatggaatt tacaccattt ccagaatgg attgtttggg
5641 agctccagg ctggagtagg agtggctcag ggaggcgtgt ttcacactat gtggcacgtt
5701 actcgtggag gaatcctgct gcacaaaggt aaaagactca cccctggttg ggctagtgtg
5761 aaaagtgacc tcatttcgta tggaggtaaa tggagacttg atggaagttg ggatggagtc
5821 gaggaagttc agttgattgc tgtccctccc aggaaaaaatc ctatcaatgt tcaaactaag
5881 cccagcattt tcaaattaaa gagtggagag gagatgggag ccatagcttt ggattaccct
5941 agtggaactt caggatcacc cattgtcaac agagctggag tcgttgtggg gttgtatgga
6001 aatggaattg tgctcaatca gggtggttat gtgtcagcta ttagccaagc agctgtggaa

```
6061 gaggtcagta gagatgagct acccggaatt gaaggctacc tgagaaaggg gcaactcacc
6121 gttctggatt ttcacccagg ggcaggaaag acacgtaact tcctgcccca aatcttgaag
6181 gcatgcagga cccgcaagtt gcgaacacta gtgctggccc caaccagagt ggttctgagc
6241 gaaatgaagg aagctctgaa tgatcacgat gtcaagtacc acacacaagc tttctcatct
6301 gccagttcag gacgtgaact gattgacgct atgtgccatg caacattggc atatagacta
6361 ttggaaagca ctagggtgat aaactgggag gttgtgataa tggatgaggc tcactacatg
6421 gatccagcca gcattgctgt gaggggttgg gctgcccata gagctagagc tcatgaatgt
6481 gcaacaatat tcatgtcagc gactccccca gggactgcaa atgaatttcc tgaatcaaat
6541 ggaggcattg aggacatccg caaggacatc cccagtgagg cttggaacaa aggtcatgag
6601 tggatcctag aggatagaag gccaacggtg tggttcctgc cctctataag gagcgcaaat
6661 aacattgctg catgtttgag gaaagccaac agaacggttg ttgtgttaaa cagacagacc
6721 tttgaaagtg tgtacccac tatcaagaca aagaaaccgg acttcatcct agccacagac
6781 attgctgaga tgggggcaaa tcttcatgtg gaaagggtaa ttgactgccg aactgctttc
6841 aagccagtgc tcagtgagga tcaggaacgg gtaacactga aagggccaat gagaatatca
6901 gcttctgcgg cagctcagcg aagaggccgt gtggggagag atccatccag agagtctgac
6961 acatattact atggagagga cacctcagag gacaatgacc atttggtgtg ctggactgag
7021 gcgtctatga ttctggataa catggaaatt aaaggggaa tggtggctcc gctgtacagc
7081 gtggaagcca caaagaccaa aatgacgcca ggtgagtgta ggctaagaga tgatcaaagg
7141 aaaacttta gagcattaat aaagaaacat gagctgcctg tgtgggtctc atggaaggtg
7201 gccaaagcag gaatcactcc agatgatagg aagtggtgtt ttgatggaga ggaggacaac
7261 accgtgctta atgacatggg ggagaaggtc atgggaagaa gcccaggagg tgcaaagaaa
7321 gctttgtgcc ctaggtggtc agacgcaagg ctgactagtg acaatgcttc cctcatgaac
7381 ttcctggcat ttgccgaggg gaggagatca tacatgagga tcgttgacgc tctcatcatg
7441 gtgccccta tgctgaaaga aaaggtggtg gatgcagcgg acaccttagc actactactg
7501 cgttccgagg agggcagcag ggcctacaaa cttgctcagg agagcgctcc agaagcgatc
7561 acaacactca tcatggtaac cttcctggtt ctgctatcag caggactggt tctgatgctc
7621 atgtggccaa aagggattag caagatgtca ttgggcatgc tcaccatgag cgttgcggga
7681 taccttcttt tggaaggagg gctcacccaa gtgcaggttg caggaatatt gctggtgttt
7741 ttcatcttga tggtggttct aatccctgat gatggctccc agaggtcaat caacgacaac
7801 aagctggctt acatgatgac aggaattatc cttcttgttg gagctgttgc tgctaatgag
7861 atgggatggc ttgaaaaaac gaaacaggat ttgtttggga aagggaaga aatgccggga
7921 tggaactggg atttgggact tgacctaaga cctggagcag cctggaccac ttatgtggct
7981 ctggcgactg tccttggccc agtgatagac cattggatac aagtggaata tggaagcgct
8041 agtttgactg gcatagccaa ttcagcaggc atttccgcat ttctggacaa ggggttcct
8101 ttcatgaagg tcaacatggc agtggtggtt ctgtttgtga gcgcatggaa tagctattcc
8161 atgctggcca tcatggaggg ttgcctgatg gcaggcattc atttttgcct gttaatccct
8221 gggctgaagg caagagcaat gaagaaggcc caaagagga tctatcatgg tctatctaag
8281 aatccagtag ttgatggcac acccactgtg gatattgaag aagctgaaga aactccagta
8341 ctgtatgaga agaaagtggc tttggcactg ctgggagttg tggctgcgct caatggaatt
8401 gtggtcagaa caccttctc catggctgaa tcaattgtgc tggggagtgc cttggtgggt
8461 ccttttattg agggtaacac gtctccactt tggaacgccc ctatcgcggt tgcgttcgct
8521 ggtctaatgc ggggacatta tagcagcatg ataggattgg cctacaattt ttggatattg
8581 caaaacccca aagaggagg tggtgagacc atgacccttg gccaggtgtg gaaaaagaga
8641 ctgaacatgc ttgacaagaa ggagtttgca aaatacaaga tttcagacat tcatgaggtg
8701 gaccgtaggc aagcacgtac cattctggac gcaggcatca ccaacgttgg agtcagcgtg
8761 tcaagaggaa catccaagct gaagtggctg acagacagag ggtactttaa gccagaaggt
8821 agggttgtgg atctcgggtg tggccgtgga ggttggtcat acttggctgc tgcagcaaga
8881 gaaacctgg aagtgaaagc ttacactcta ggtgtgtcag gcatgagcg accaattcaa
8941 atccaaagcc tgggatggaa tgttatcaag tttaaggaca gagttgatgt gcacagactt
9001 ccaatcgccc aatgtgacac agtgatgtgc gacattggag agtcttccag ctcttgggaa
9061 caggagcgag agagaaccct gagggtaatt gacctgatgg agaactgggt ggccaagagc
```

FIG. 25 cont.

```
9121 agacccaaat actgcttcaa ggttttggct ccctactcct cagaagtgat tgagcgtctg
9181 gaactgtttc aaagaagatt tggtggcggg ataatcaggg ttccactctc acgcaactca
9241 acccatgaga tgtactacac tagtgaggtc accaataaca ttgtgcacat ggtgaactgc
9301 gtctcaagat tgctgctccg gagaatgacc aaccccagtg gaatagccat cttagagcca
9361 gatgtggttt ttccaacagg aacacgcaat gtcaaggggg acttgggccc cttggacatg
9421 gagaagatca agatgcgtgt atccaagtta aaaaaggaga acttggacac atggtggcat
9481 gatgaaaatc atccatacag gacctggcat taccttggaa gctacgttgc taaacagagt
9541 ggcagcgcag ccactatggt caatggaata gtcaagctac tgagcatgcc atgggatagg
9601 attgaggatg ttactgcctt ggccatgaca gacacaacac catatggaca gcaacgtgtg
9661 tttaaggaaa aggttgacac tagggctcca cccctcctc cagggactag gaaaatcatg
9721 agcattacca acacatggct ctttgatttc cttggccgaa gcaaacaacc tagactgtgc
9781 accaaagcag agtttatagc aaaagtcaga tcacacgctg ccataggcaa catgttggag
9841 gagcaggaag gctggaaaaa tgcagctgag gcagtgaatg atccaagatt ttgggaattg
9901 gttagtgaag agagggagct acacttacaa ggaaaatgct ccacatgcat ctacaacatg
9961 atgggaaaaa gagagaagaa acccgctgaa ttcggacgtg ccaagggaag cagagccata
10021 tggtacatgt ggctcggagc taggttcctt gaatttgagg ccctgggttt cctcaatgaa
10081 gatcattggt tctccagaga caactccaag ggtggtgttg aggggatggg cttgcagtac
10141 ctaggctatg ttgtggaaga tgtgtggaag aaggggaatg gaatcatgta tgcggatgac
10201 acagctggat gggacactag gataacagag gctgatttgg aggatgaaca ataccctgctt
10261 gaaaagatga gtggcactca caagaaactg gcttgggcta ttacagagtt gacctacaag
10321 aacaaggtcg tcaaggtccc tagacctgga cctggaggaa agattctgat ggatgtgatt
10381 gccaggaggg accaaagagg ttctgggcag gttgtcacct atccctcaa cactggaaca
10441 aatctcaaga cacagttaat aaggatggct gaaggcgagg gcataatcac cccagaggac
10501 acactccaac tcagtcacaa gaatgagaaa aatttgagggg aatggttgtg cacccatggt
10561 gctgaaagac ttggtagaat ggctgttagt ggtgatgatt gcattgttgc gccaattgat
10621 gagaggtttg gcaacgccct aagtcatctc aatgccatgt caaagattag aaaggacatt
10681 gatgattggg agcccagcaa gccttggatg aaatgggagg aggtgccatt ctgctcccac
10741 catttccacc atttgctact gaaggatggc agaagaatta ttgttccatg ccgaaaccaa
10801 gatgagctga ttggaagggc ccgagtgtca ccaggaaatg gatggatgat caaagaaact
10861 gcatgccaca gcaagtccta tggtcagatg tggctcctca tgtatttcca taggagggat
10921 ctgagattga tggctaacgc aatatcatca tgcgttccta tcaattgggt gccaactgga
10981 agaactacat ggtcacttca cgctggagga gagtggatga cctccgagga catgctggaa
11041 gtgtggaaca gagtttggat tttggacaat cctcatatga gtgacaagtc agtaatccta
11101 gagtggagag atgttccata tctggcaaag agtgatgata tcaggtgtgg atcattgata
11161 gggacatcac agagagcctg ctgggcagct aacatccgtt ctgtggttga gaaaatcagg
11221 catttggtgg gagatgagaa gtacaaagac tacctgcact ccatggacag atatgccctg
11281 gaacactccg aaattggctg cttgatataa attaaagcac tccattaaac caaccaaaca
11341 ctccttcatc aaacaacact ccatatttaa agtgtcaggc cgggaaaccg ccatggctaa
11401 gctctgaggc catgcagtct gggagagcag cacattcttg cccacagttg tgcttaatta
11461 catttttggg agcctcccctt tgtcatgcga tgcatggtgg caaagcgacg aggactagtg
11521 gttagaggag accctcccctg ggctatgcat caagtcggac cgtttctacg ggaagctgta
11581 aaccgtactg tccgtgacag cattccgaaa ggttgggcga agctgtaagc ctgtaaaact
11641 ttggagcctc cgctctgcga cccgtgtaag cagagtcgat ggggactagt ggttagagga
11701 gaccctccac agcaaacaac acacacggat cacattgaca ccagggatag accggagatt
11761 cttcttgcct ctcgacagct ttaggcaccg attgccaaac tacgaagctg tcgagaaacg
11821 acaagaatct
```

FIG. 25 cont.

>SEQ ID NO:17  Karumba virus polyprotein

MQVKKIKMRGGGGGKLGIKGIKTSSLRRALNMVSGDLNETLLKLVIAMIAIWNELLRNL
RSLGRRVRKETRQRTGNNKHVVACFIIGLMAALACAKTMNGIMDKGEHVWKADWNV
DFTNVKLPKDFCGSGIHVEKMCPQVDSLQDATIDCAGRHDQFLLSYTRCAAKNRVKRG
EPGVVEPKVTNIWTITFNDELNSIIERVSGMLKNNRLMATAVICLVGAFKKWPTWLVVL
LVLLPWTVVQASLADPFLILPKGDGLVKTRLYPGQISSISTHVGVLDISYMAVDIEEGRL
VERLMSHCEVNGTYSQDCCALGCNLDLSKLNERNRACQTATYNRGWATGCPVFGLGS
VATCVEVACSDSVEVSELTSQNIRIPLSLRLQHEELNVTMTTEAPVTSKFSHHGVVSISCQ
IGNPGFLAQQYVLSNGKHKAMFPISAVSGWPGIREIGGQYRNVDGSVKWGHVEANEIK
VAAVYSDSIQWKTGIPIKTGIRDPLYLYCEVSLTDLTFKKIRACESPVEVSFMAGPTGLD
GRLEIGLLEQVNKTCSITGSCEGCTLPHPTSVISTSDKKGHMHVECRTGTFTAIFGKQKFS
FTCXTSYLRTIWATTAQAIGNYRKFGLDASGGPFLDLWNKIGPNFSRLEVVGILVVAALL
IDKRLLLLLAIFGYVTYVRADVGCGIDLSRKTFSCGEGIFLWNDLSSQTWAYGVEVVET
KLLEAYISQMLKERTKVCLLCEDILQCSAARRLAAVVAKSNPDVYYNDSLSYGAVFPM
RKKSQITITADGRSAVVASFVIEGMITNSALGKLQWNVWNPRPTAEAMDDKVIRVLTTG
SNITSVCSKAIGFEYVFERFTRKMYGSSVLVKSTSHISHTCPTYLAGAAIKNNRTIHTDGF
LWMDSALQANGTYRLSSLSVLQSHECEWPVTHTINPTDPKDRSLFMPARFGAPASRAN
HMPGYLTQRTIPWDKAPIKLIYGVAPGTTIKEFPTCDDRGDALPILSQETREWCCKTCLS
KGTPPFHLVVDGSLYYPEEVRPIPIPTKITESVAQPVTPPPVMKTMGAEATQDFQMGPGE
GTFARLALLALALHLISQNTRHGWITRVACAAMLFSVTGLPYHLRYWWPVIGFSVLKN
ASGQSLLVSLWLALHTTGGHLVCLGSLLRQTRWCYRLQSLMMLVASLSLYRFRGITWL
MNIIDLVAPLISISFLYKARTLLLGEVVLIGSGLALSWGNALLTLGVLFGTHMVIASLRKT
ANAFEPGLRANISLCNFPQQVVRDMWTVLKNWRRAPAPWRSSGRTHISQLAVYLLLLG
LAYAFHLLNLEVLAGACVLIGFLWILMGEMLTSGELELRRVSALEIPQGLEKIVIDRDFQ
SEYGRFTDAGVKLDNFNDETNVKFSLLSLGFVAALITVNPVCGLTIGFLIWIFTSCPLAKD
LAMAASCFRSDDGFAVLIPGVKEVAIGTRFFTLSDGVYSVCRRSWNGLSHVGAGVAKN
NVFHTLYHVTRGEAISWASEKVGPTSGCALRDVVTYGGDWQFPLVTEDEAVVKIVNSD
LTVSHCYTNVLSLNVQGEEYGVIGHDFMEGSSGSPVFSSQGEIMGLYGYGFYDRENRYN
SLISYMKMEKEEEKVKTTEEQPTMRGTRTFINWHPGKGKTRKVILEEAVRHVNENKRLL
ILTPTRVVMTEVLQALTGNLPFGVRVGKHLSKSRSFQITVACHATLTSHVLQHGLKINFS
TVIMDECHFLDPLSIAARGIMEHMHSKGAALMYLSATPPGKAPQAGSNYPIIDVPSMPR
DVDRNFVTSQAGXKTIVFVPTIAQAQKLSDQIPGSVVLSRETFDVNMSKAANPETKVVIS
TEISEMGANLGVDTVIDTRLCVRPVVDGRFKVRLVKVPITHASAVQRRGRTGRRQPGRY
IFDDKVEPSDECSHWVCWREAQMLLDQLDMTPMPEEAENFDPPGHYKLLSDQLKQFM
ELLTTEMPIWLAWNWANASSSRHTVIFGGSEVTDKTTPVITTPSGKQLYNPQFVDDRFE
ADDLTKFHATIQKYLRMRAHINWEGLAQGLWHVVTKSDSSMFKVAFQNTMERLHDLS
RWDDDSLRTSDMTESVGTWIIVMLTAVSTFIISLLIFACCRCCKSSKTTRSQEVVYTXTV
AERNVSGLWSSMTVPVLGWVAGIPGPILFVVAVCLGLVCAFMCNSATRSYVDHTLSW
WVMVLSCIVAGLVAFELDLMPRTFAILSRVAATGARFDTGPSVEPFIVTGRHVTVELWV
VIMAMYLTALIIAPILKSYIQGKSIAAVFANEPVASAYIGGMRLTTIYALQATICVGLFYF
HANLPSCVVASVASFLFLMVFAFDVKYAFSPAVVRALEAKNNKRDTDRPSLERDEETK
GRQLYYTLSVVMVALWVTIVRDQLTFVTAAGVGLHALMCLIVPDHPFHRNINQGIVTM
LFGFLVEPVKWTFIVGFFLWGVMHYTSPNSYRSSNKGDAMNVGMKWKRLLNSLNQKQ
FDAYKSRSVDETPRGDYVSRGGLKMREIMEVHGWEPNGKVVDLGCGRGGWSQHLAM
DRRVTEIKGYTLGGSNRENPEVFMTYGYNLCTLKPMVDVYKLEPFVTNTVICDIGESDP
SAVVEKTRTLKVLTLLENWLTVSKEANFVCKVLSPYHTEVLKKLETLQHVYGGRLVRL
RLSRNSTAEMYYISGPRSNMVKAVYATLRALTGRLSLYDTPFESLPPTLPTGTRADPKA
KAKAADFSLLARRIQKLQQENQHTWFHDKENPYTSFSYHGSFVTDAVSGGGQTVNPIIR
RLMWPWEQVAKVTGFMMTDVSTYAQQKVLREKVDTYVEEPDHRMKQINRQLALFIA
DLYKKQGLRPRILSKQDFVANVRSDAAVGGWASDMPWADVEGAITDPVFWDMVDRE
RQLHLGGDCELCVYNTMGKKEKKPAVLGKAKGSRTIWYMWLGSRFLEYEALGFLNQD
HWVSRDHLPCGVGGVGVNYFGNYLKEIAEKGKWLIADDVAGWDTRITESDIEDERSLL
LSLVKDPYHKALMDSIFTMAYRNIVALFPRNHKKFGSGTVMDVVSRTDQRGSGQVVTY
ALNTITNAKVQLGRSLEAAGLLEADDRTIQVWLRNHGEETLRGMTVAGDDVVVATNS
DSFHTSLHYLNRNSKIRKDIGPLEPSRRCDNWEEVEFCSHHFHPITLQDGRVLIVPCREQN
EIIGRSRLQKGGIVSESEGACLAKAHGQMWALYFFHRRDMRLAYAAITACVPSHWFPK
GRTSWSVHQKHEWMTTVDMLEVWNNVWIHDNPWMTNKEPVSSWSMVPYLPKKQDI
ACGSRIGTTDRTLWAKEMPELVSKLRRVLDKHEGPQQYTDGLAILGRYQQSPGNTADIY
V

FIG. 26

>SEQ ID NO:18          Parramatta River virus polyprotein

MSGLGGGLLPLRGKKKKAPVIQSQGRVLPKSDWKGAPKQDLNKKKAKKDETKGQNWP
RRINPRTGQWSAIEGSGARLWRSIFSTDLIGGLLLLIAILSNLYEKVRRDITELKRRVTRLE
KSRASLILTPMVLLCLAILAAGVTIQVVVTTDARIELWSDRKNFTAHAHLVKVPTDVCN
DGVFVTKHCPKVEKLSDLGEIDCGSSWSEFTLTYTRCVTLERASRAEEKGKTMLGQFKE
DLSTLETEAFLLFKKHAFSTILVLLVLAIVMKWPVWVVVILGILAWNVVKGEFVEPFLV
LKHDHSTMLMTRLYPGEIAHVATPAGLVDIRVSHAQIFGGQRFRELLSDCSVNASYSTDI
CPGGSQLDLESIKGPGRVCMTAPYNRGWGTGCFKWGIGAVATCVELNCTRETKVDLLT
NSAIVANVTVNFHSTNDTKLLVPDTPITLKFGKLGTMTMTCRLGNDRIANDFYHVTDNI
ASGLFQKALIDAWEGPSKMANHISGHEKVVKWGHILPNEIKVSKIIEMELDWEKAITTH
DGFSNTYFWCQVAVNKLVVGSFASCKSGAKASFIQSSWGFDGVVEVTLDEATKTICSLP
LTCTGCSLLATKVVFLEGSQRAVGHVGCGNGTSMLTVGTTKVGIQCVVTPVSQIWNFV
THASGRYAKLGFGGVGGAFHDLLVKVGLTFTWDSWKIITVLSGLVVAFAIFDRKLVILII
ILCGIAYTRADIGCGIDFDRKTYTCGSGLFVWKGLGKYPTADHSVEFASYDFLSAYLQE
QFKSEKKVCIICEDIVQCEAARKAAAAVYKNLGHPFVYVNTSDSYGKVFAEIPKRVHTV
SVGVDVVEMAMMTRENKPVGPFGDLPRSMVSWKSIPETEEHPVLRVLTSSSDYQKVCG
KAIGFQYDFVGYRRTMYGSNVQLKISKKVSIECPTYLAGVAVKNDRTVFTDGMFWMSS
KRENGTYAITELEMEQSHKCIWPDQYTPDATLTPRDNEMFVPPEWGGPMSKANHIPGY
KMQTGFPWNKAPIRFVEGSVPGTIVTQISHCDGRGIAAEVNPATQPNWCCKSCTRIFHFE
VDGKLYYPMEIRPDPKGGEQQKVPVVETPIGDEETETVGGWLGRMYNIPGAEGSYADF
RLPKLPNSRPSAMVGSLVNLLCLMFSIQIVTKTMRARTLMRFYLCCLVFMFFGMPTLFG
LSGFLAWMMILPISHNSVTMCNLTVHLWAVLLNQSSAMFLWGLTLRSQIQRSTAGQML
LFTMQMLHHAIYAHSWVFGWVIEVCLSVGLMMNLLTVIDTVHPKLIAYLLFFGWKTG
MCVVCAWLLIYSIRRWNSIVAAAPAAGGWRSGYRTMMSSSLIVIFISVGIAGVIASDYGG
YPAAAAVTAALLIMGIKMFDFLTTRLSLEFVSAGMFPEGVEKAFEPDSVSDLFRASFTVD
GIKLQDHVEPIPILFAILYIFIGAVACKVNPALGIVYAIAMFATPLPELMRLYMMTIYSSTF
RTDTLLGMAIPETEPELSQDFGPIPDGIYRVNNHGFSVKSHRGVGIVKNGVFHTLMHVTL
NEPLAWQNRLVGPSMGHSLKDYVTYGGNWQLPDFDIVNEVGIMVCGRDRSIQYKRHE
VGTIMIDDKRVMYFTHDYGHGSSGSPIFVNGEPVALYGFGFHLYNRYRSIVLPIPREEVL
DGASNEGIPAEHGTMRNKFFVDWHPGKGKTRKVIVKEVLNALNLARRIVVLAPTRVVL
AEITKAIGENTSKTPSKNLAFTGHNIVTVACHATFTDYVLRHGLSKFKAHEVIMDECHFL
DPRSIAARGILEHLATKRGVKVTFMSATIPGREPSLGSNFEISEQALQFPRDVNQRWIETV
ARGKTVAFVPSHRVGDKLARGCPQAISLHRNNFDTNYSTAMDESIKFIYTTDISEMGAN
FSADTVIDFRVAIKPKISSEFAVTLEPTPITRSSMIQRRGRVGRQRPGTYIYPVDKGVEDAS
DQLACWTEAQMLLDQLDLTMMAEEVRQSNIPGAYKLVGRSLDIFRKLLEKDDIPIWLS
WKWADSVQQQYSILFEGERQENVARVVNTRDYASLEYKPKFVDARFERLGWDQRKLS
IQFYMNTRSFITFATLSHVISQVIEAGVVNSAWKRIGDVSIIFTEGGDPHAKDETIMAWTI
LVGGVLGALGFLIVAWGMKAVLRVIFGSRDKHLSVPTLVADFQPYIVCIVPIALHLAGV
PIPMTIVFFAMLFLTYPLMYKSAGQRSYVDIDLVKWILLGGCIVTGVICWEMRLLPNISS
DISAILNRQRQREDTPTFDASPPWEWLDLAQPVPHNVELTSVVITTFTTCLFLHQIVGWS
YESEWLKSYFDHKGVGQIMGGFRLDTISWGSALSGLLGTATYASWGAILTGLGGAVVY
FFLMVSMLKWNFSGGATTGLENNVMRNDRETGLGNRPANDNRRSLLYGVVAAECLV
WLFCFRTATDAIVVACLVSYCLWIINNPASPHHKNTDLGSACSFIGLLYCTCPTQKCIQV
LMRFALARLNMNTRSLEKSATGGLGHRWKKLLNAMTLLEFNAYRSCGVDETEKGDYV
SRGGLKLREITMKYGWKPEGICVDLGCGRGGWSQHLAMDPRVTRVESFTLGGTARENP
QPIKTLGHNLIRFKSGVNVYNMTPTHANTIVCDIGESDPKPEVETSRTLRVLKTLELWLA
RNPNAEFVCKVLCPYPVEVLKCLETLQHKYGGRIIRSTYSRNSSAEMYYISGGRNNMVK
VIFTTLHSLISRIRTRPEKIVKESVSLPVGTRSDPGHKIKSMDPKMIATRVEKIKKEHADT
WFVDNNHPYQSFRYVGSYVTDDVTPGGQTVNPLMRKMMWPWETVGGVVNFMMTDV
STYAQQKVLREKVDTLSPEPPNDIQRVNRWITEFLCASFMRRGLKPRILTMEQYINNVKS
SAAIGSWSSDVPWSSVREALADKRFHQMVEEERKLHLAGDCRMCVYNTMGKKEKKPS
AMGVAKGSRTIWYMWLGSRFLEYEALGFLNEDHWVSRDNLACGVGGVGVNYFGYYL
QEIARKGKFFIADDIAGWDTRINESDLADEEFLIMSLICDPYHRSLAKAVFRFAYQNIVAL
FPRNHPGFGSGTVMDVVARTDQRGSGQVVTYALNTITNAKIQLGRMLEAEGLLDAHEH
VIKKWLNDNGEEALSGMVVAGDDVVVATNNGNFSRSLRYLHLNGKIRKDIDPSLPSKV
ETNWEVVEFCSHHYHVMTLKDGRRIIVPCREQNEIIGRGRIQKGGLVTLAESACLAKAY
GQMWALYFFHRRDLRMAFLAITSSVPIDWFPEGRTSWSIHQNKEWMTTEDMLRVWNT
VWIQDNPWMEDKMEIENWRDIPYLPKSMDLKCGSLIGTKERAAWSKDLPSTVTAVRKII
DQDTKTENVYQDFLGGMGRFQTYTDPMAT

FIG. 27

>SEQ ID NO:19          Cell Fusing Agent virus polyprotein

MKRKDLEARGKAPGRDFSTPFWGREGRRKDKEKGGESPSNRQVTLNTPIQSGRRAGKR
QRVGLLGRLGVGWGSFLQEDIVQALIHMALVLHALFSSIDRRIRSLSRRVTALESRRTTG
DPMTLAFILGFLTVLCGCVVIDMQVSTAKGTEIFEGKTNRTDYLHLVKLPADGCWSGIL
VTKKCPKVTDLAKDLESTDCGSTWTEFTLRYRRCAVKKREKRSREPPKADLLAEMEIIA
FKTIRENKTIFIVALLCVAIAKRWPTWVVILLAIGTWTTVKGEFVEPLYTLKAEQMTMLQ
TIVRPEEGYVVATPNGLLEFKTGPAEIYGGQWLRELLADCHVNASYSTDVCPGGSQLN
MADIMAKERVCSTQPYNRGWGTGCFKWGIGFVGTCVELHCDRGFNVSSIARSAIVMNV
TASFHSVSDTQQMVGDIPLTFRFAKLGNAAMTCRLESEQLLLDYYHVTGSSHEGLFLRS
QIDSWPGVHSTASGRHGMEKVVVWGDARSNEILVKNVIEPSLSWEDAIATHDGFRDISF
VCQIMLDKLVSGAFRDCPGPKTSTFSQDGFGYSGVVITTLTASSNETCSLSLTCHGCLLQ
STKMIFLAGKTTSRAFVKCGNHTSTLLVGSTSVSIECALNPISQGWRLARHVVDRYRRFG
VSGVAGVWQDLVGKFSVGAFFSNTTLLVIFVLAALIDKRIAFLLVLGGYFYYVRADLGC
GIDTTRKTISCGSGAFVWKHLGVGISNDHAVELEDYSFTDLYIKDMFSWTTKPCLICEDA
LQCVALRRAAFSAVGSMGPEQVYVNDTLARTFKFSETPKRTISVTINLIQYKFSSYVAHG
RAEGDLGHLPTMFGSYPEKEADKVIRIVASRPDIRRLCGKAVSFQFKFTGFRRGLYGSNV
QVEVSKNSSTECPTYLAGVVVKNGRTVITDGMFWLESTVLDGVAQITSLEMRQSHRCV
WPREYTPDTLSDPSDQALFIPPAWGGPISRVNHIIGYKTQTDFPWNVSDITLIEGPAPGTK
VKVDSRCHGRMHAQVIGPNDTESWCCQSCTRIVHFRVGDLLYYPMEIQLGTMSEAPEP
NSKIFEEPIGEEPEPTVDDILKRYGKANAQSDFRRVSPRAGVGFDRSLLNLLCLAISLQLIG
AKTRTSTLTRLFLTILAMALFGLPNLFSSVGLSAWVLLVASSSSQPQDLLMNLWIILQTG
SSAVLLLGYMIRKKLSIVLGVHHLVTLMCIQFLFSAVDRYQKYLYGLLELMASVVLLSA
YKSVLQALPPEVLCFSLIMGWKTALSLATVVSLIFSLNAMYKYACQYHNPRNGYRDSG
ANLWFWTVSLASAGGIWAAEKAHQPTVAAVLAFTMIVLFLYMEQTNVSMELEFISAGE
TPEGVSTENDDGMNIPDLKGRYGEDGIVVGAASSSGHLPELVFVFLLGFAVTSTSYFLGA
LYLLIATSTNLPVTIIRMLRMKLTANNRSDDLLGLGGPIETDLQTSFQDIPNGVYRIVVRS
LFGDRQRGAGFSKNGVFHTLMHVTRGEPVKWRGRVVVPHSGSALRDVVSYGGPWQL
DTPTTTEDLVLMACKPDKTVEYHRYRPGVMSIDGEPVMFISDDFGKGSSGSPFFINGEPV
GFYGFGFYVNGIYRSTVAGGKPTDVTENLDCDSTRRFVTWHPGKGKTRKVIVEETKKN
YDSNQRTVILTPTRVVMAEVVEALKNSGMRSDKNLSYCTRNLITVACHATFTKFVLSHG
AKKVRVAMIIMDECHFMDPMSIAARGIMEHLHSQGTKLIYLSATPPGHAPDTGSNYAIS
DQSISFPTWLSPAWIGNVQKSVGAKKTILFVPSHNQANTLASAIPGSVPLHRANFSTNYA
QAGDAATALVISTDISEMGANLGVDLVIDTRRALRPLVDSATRVKLVETNITTSSMIQRR
GRTGRREPGTYVYPIDSQTEENPVSWACWPEAQMILDQLGMTFMLEEAAYSQPPGRFT
LVGEDRMRFSKLMDRDDIPIWLAWHWAEAGDRRHSALFQGEGTGKIIENRFGKQEYRP
QYVDDRFESVEWETRKVSIDFYMNCRGGPSLYEFFTLIDWTDIWRRTTSALWDLSDVM
NGELRDRSTTERSLTVLMAFVLGVSIVLSCFIAVWALCFLFSLFRPRKVTYEQMPSSDPL
SGGVLVSTPSLLYYMGVPLGFCVVISLAMFLVYPVLYKSIGNRSYMDSDLVKWVILGSC
LICGVLAWEMRMFPNIRGDLMELVKAVKEPEEVVNSGPFFPSWEIARGKGATMLDSLQ
VFFFITVLSTKFLYWFQENWTARMYAMKHPEMVSSIGGFRFDEIPFRAVLPSGFAIVAIA
SLSSVVVGLLAAGVFMAIMYCQNKWNATPKILTALDARDQRHDRPTEITSRVPLENTRS
IMYAFCLIFSLFWAFCTRSPGDFLRGSLVVGASMWQILHPRSKIHDVMDFGSMVSAIGLL
EMNYLFYRFMHIAARALGAVAPFNQFRALEKSTTIGLGMKWKMTLNALDGDAFTKYK
SRGVNETERGDYVSRGGLKLNEIISKYEWRPSGRVVDLGCGRGGWSQRAVMEETVSSA
LGFTIGGAEKENPQRFVTKGYNLATLKTGVDVHRLTPFRCDTIMCDIGESDPSPIKEKTR
TLKVLQLLENWLLVNPGAHFVCKILSPYSLEVLRKIESLQHLYNGRLVRLSHSRNSSAE
MYYISGARSNVVRTTYMTLAALMARFSRHLDSVVLPSPVLPKGTRADPAASVASMNTN
DMTDRVERLMNENRGTWFEDQQHPYKSFKYFGSFVTDDVKVGGQAVNPLVRKIMWP
WETLTSVVGFSMTDVSTYSQQKVLREKVDTVIPPHPQHIRRVNRTITKHFIRFFKNRNLR
PRILSKEEFIANVRNDAAVGSWSRDVPWRDVQEAIQDQCFWDLIGKERALHLQGKCEM
CIYNTMGKKEKKPSLAGEAKGSRTIWYMWLGSRFLEFEALGFLNADHWVSREHFPGGV
GGVGVNYFGYYLKDIASRGKYLFADDIAGWDTKISAEDLEDEEALLTALTEDPHHRAL
MAATMRLAYQNIVAMFPRTHSKYGSGTVMDVVGRRDQRGSGQVVTYALNTITNGKV
QVARVLESEGLLHADESVLDAWLEKHLEEALGNMVIAGDDVVVSTDNRDFSSALEYLE
LTGKTRKNVPQGAPSRMESDWEKVEFCSHHYHEMCLKDGRILIAPCRHENEVLGRSRL
QKGGVVSISESACMAKAYAQMWALYFFHRRDLRLGFIAISSAVPTNWFPLGRTSWSVH
QHHEWMTTDDMLRVWNDVWVHNNPWILNKESIESWDDIPYLHKKQDITCGSLIGVKE
RATWAREIENSVISVRRIIDAETGVLNTYKDELSVMSRYRRGNDVI

FIG. 28

>SEQ ID NO:20   WNV<sub>KUN</sub>/PCV-prME chimeric ISF protein

MSKKPGGPGKSRAVNMLKRGMPRVLSLTGLKRAMLSLIDGRGPTRFVLALLAFFRFTAIAPT
RAVLDRWRSVNKQTAMKHLLSFKKELGTLTSAINRRSSKQKKRGGKTGIAFMIGLIAGVGA
VVVIDMRVTYDGQVQIYRDGENMTDRVALFKLPTDGCSVGLPVSKMCHKVDKNMKEGLA
DTDCGSTWAEFRLRYQRCQVKTRAKRVAPDGPKQDFLAEVEIVAFKAIRENKSVLLVVVLC
VAIAKRWPLWVLILLSIGTWTTVRGEYMEPLYVLKADQMTMIQTTLRPEEGYVTATANGLF
EMKTGRAFIYGSQVVKTLVTDCEVNATYSTDICPGGSQLSMQDIQAEGRACASEPYNRGWG
TGCFKWGVGFVATCAEVDCTTSVKVSSVARSTIKMNVTATYHSVKSVQSVISDVPVTFQFG
QLGIASMTCRLESDRIAQSYYHVEGNKKEGLFMKEQIDGWNGATLAAGKIANTEKIVIWGD
VKPNEILVKAVSEPQLEWTNAIATHDGFRDVGFVCQIMLDKLVTGVFKDCKTPKTSTFTQSG
FGFDGIITTTLAVAQTEACSISISCKGCTLLATKAVFSAGDIESKTWVRCGNESGTAIVGGQEV
AVACATNPITQGWRLVKHATQRYRKFGMPGVGGVFHDLVGTLNPWSFFSTTTLVFMAVVL
FIVDKRILILGIACYMFYFVRADTGCAIDISRQELRCGSGVFIHNDVEAWMDRYKYYPETPQG
LAKIIQKAHKEGVCGLRSVSRLEHQMWEAVKDELNTLLKENGVDLSIVVEKQEGMYKSAPR
RLTATTEKLEIGWKAWGKSILFAPELANNTFVIDGPETKECPTQNRAWNSLEVEDFGFGLTS
TRMFLRVRESNTTECDSKIIGTAVKNNLAIHSDLSYWIESRFNDTWKLERAVLGEVKSCTWP
ETHTLWGDGVLESDLIIPITLAGLRSNHNRRPGYKTQSQGPWDEGRVEIDFDYCPGTTVTLSE
SCGHRGPATRTTTESGKLITDWCCRSCTLPPLRYQTDNGCWYGMEIRPQRHDEKTLVQSQV
NAYNADMIDPFQLGLLVVFLATQEVLRKRWTAKISMPAILIALLVLVFGGITYTDVLRYVIL
VGAAFAESNSGGDVVHLALMATFKIQPVFMVASFLKARWTNQENILLMLAAAFFQMAYYD
ARQILLWEMPDVLNSLAVAWMILRAITFTTTSNVVVPLLALLTPGLRCLNLDVYRILLLMVG
IGSLIREKRSAAAKKKGASLLCLALASTGFFNPMILAAGLVACDPNRKRGWPATEVMTAVG
LMFAIVGGLAELDIDSMAIPMTIAGLMFAAFVISGKSTDMWIERTADISWEGDAEITGSSERV
DVRLDDDGNFQLMNDPGAPWKIWMLRMACLAISAYTPWAILPSVVGFWITLQYTKRGGVL
WDTPSPKEYKRGDTTTGVYRIMTRGLLGSYQAGAGVMVEGVFHTLWHTTKGAALMSGEG
RLDPYWGSVKEDRLCYGGPWKLQHKWNGQDEVQMIVVEPGKNVKNVQTKPGVFKTPEGE
IGAVTLDFPTGTSGSPIVDKNGDVIGLYGNGVIMPNGSYISAIVQGERMDEPVPAGFEPEMLR
KKQITVLDLHPGAGKTRRILPQIIKEAINRRLRTAVLAPTRVVAAEMAEALRGLPIRYQTSAV
AREHNGNEIVDVMCHATLTHRLMSPHRVPNYNLFVMDEAHFTDPASIAARGYISTRVELGE
AAAIFMTATPPGTSDPFPESNAPISDLQTEIPDRAWNSGYEWITEYIGKTVWFVPSVKMGNEI
ALCLQRAGKKVIQLNRKSYETEYPKCKNDDWDFVVTTDISEMGANFKASRVIDSRKSVKPTI
ITEGEGRVILGEPSAVTAASAAQRRGRIGRNPSQVGDEYCYGGHTNEDDSNCAHWTEARIM
LDNINMPNGLIAQFYQPEREKVYTMDGEYRLRGEERKNFLELLRTADLPVWLAYKVAAAG
VSYHDRRWCFDGPRTNTILEDNNEVEVITKLGERKILRPRWIDARVYSDHQALKSFKDFASG
KRSQIGFIEVLGKMPEHFMGKTWEALDTMYVVATAEKGGRAHRMALEELPDALQTIALIAL
LSVMTMGVFFLLMQRKGIGKIGLGGVVLGAATFFCWMAEVPGTKIAGMLLLSLLLMIVLIPE
PEKQRSQTDNQLAVFLICVLTLVGAVAANEMGWLDKTKSDISGLFGQRIETKENFSIGEFLL
DLRPATAWSLYAVTTAVLTPLLKHLITSDYINTSLTSINVQASALFTLARGFPFVDVGVSALL
LAAGCWGQVTLTVTVTSATLLFCHYAYMVPGWQAEAMRSAQRRTAAGIMKNAVVDGIVA
TDVPELERTTPIMQKKVGQVMLILVSLAALVVNPSVKTVREAGILITAAAVTLWENGASSV
WNATTAIGLCHIMRGGWLSCLSITWTLVKNMEKPGLKRGGAKGRTLGEVWKERLNQMTK
EEFIRYRKEAITEVDRSAAKHARKERNITGGHPVSRGTAKLRWLVERRFLEPVGKVIDLGCG
RGGWCYYMATQKRVQEVRGYTKGGPGHEEPQLVQSYGWNIVTMKSGVDVFYRPSECCDT
LLCDIGESSSSAEVEEHRTLRVLEMVEDWLHRGPKEFCVKVLCPYMPKVIEKMELLQRRYG
GGLVRNPLSRNSTHEMYWVSRASGNVVHSVNMTSQVLLGRMEKKTWKGPQYEEDVNLGS
GTRAVGKPLLNSDTSKIKNRIERLRREYSSTWHHDENHPYRTWNYHGSYEVKPTGSASSLV
NGVVRLLSKPWDTITNVTTMAMTDTTPFGQQRVFKEKVDTKAPEPPEGVKYVLNETTNWL
WAFLAREKRPRMCSREEFIRKVNSNAALGAMFEEQNQWRSAREAVEDPKFWEMVDEEREA
HLRGECHTCIYNMMGKREKKPGEFGKAKGSRAIWFMWLGARFLEFEALGFLNEDHWLGRK
NSGGGVEGLGLQKLGYILREVGTRPGGRIYADDTAGWDTRITRADLENEAKVLELLDGEHR
RLARAIIELTYRHKVVKVMRPAADGRTVMDVISREDQRGSGQVVTYALNTFTNLAVQLVR
MMEGEGVIGPDDVEKLTKGKGPKVRTWLSENGEERLSRMAVSGDDCVVKPLDDRFATSLH
FLNAMSKVRKDIQEWKPSTGWYDWQQVPFCSNHFTELIMKDGRTLVTPCRGQDELVGRAR
ISPGAGWNVRDTACLAKSYAQMWLLLYFHRRDLRLMANAICSAVPVNWVPTGRTTWSIHA
GGEWMTTEDMLEVWNRVWIEENEWMEDKTPVEKWSDVPYSGKREDIWCGSLIGTRARAT
WAENIQVAINQVRSIIGDEKYVDYMSSLKRYEDTTLVEDTVL

FIG. 29

SEQ ID NO:21 WNV$_{KUN}$/PCV-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg acaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata aacaatgtat ggtgctaatg ttgcttcaac aacaattctg
 481 ttgaactgtg ttttcatgtt tgccaacaag cacctttata ctcggtggcc tccccaccac
 541 caacttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtagggggg cccacacggt ttgtgttggc
1201 tctcttggcg ttttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcggag ctcaaaacag aagaagagag gaggaaagac
1381 cggaattgca ttcatgattg gcttgattgc tggcgtggga gcagttgtgg tgattgacat
1441 gcgtgtgacg tatgacggac aagtgcagat ttatcgcgac ggagagaata tgacagatcg
1501 agttgcgctc tttaagctgc caactgacgg ttgttcagtt gggttgccag tttcaaagat
1561 gtgccacaaa gtggataaaa acatgaaaga aggattagcg gacacggatt gcggatcaac
1621 atgggcagag tttaggttga gataccaacg atgccaagtg aagacacgag cgaagcgagt
1681 tgcgccagat ggcccaaagc aagactttt ggcagaagtg gaaatagtgg cttttaaagc
1741 catccgggaa aacaaaagtg tgttgcttgt ggtcgtgttg tgcgtggcca tcgcgaaaag
1801 atggccattg tgggtgttga tactactgtc gattggaaca tggacaacgg ttcgaggaga
1861 atacatggaa ccgttgtatg tattgaaagc agaccagatg acaatgattc agacaacgtt
1921 gaggccagaa gagggatacg tgacagcgac ggcaaatggg ttatttgaga tgaaaacagg
1981 aagagcgttc atctatggaa gccaagtggt gaaaacactg gtaactgact gtgaagttaa
2041 cgcgacatat tcaactgata tatgcccagg cggatcgcag ctgtcaatgc aggacattca
2101 agcggaagga agagcatgtg cctcggagcc gtataatcga ggctgggca ctgggtgttt
2161 taagtgggga gttggattcg tagcaacatg cgcggaggtt gattgcacca ctagtgtgaa
2221 agttagctca gtggctcgct cgacaattaa gatgaatgtg acggcaacat accactcagt
2281 gaaaagtgtg cagagtgtga taagtgatgt acctgtgaca ttccaatttg ggcagctggg
2341 cattgcctct atgacatgtc gtttggagtc cgaccgaatt gcccaatcat actatcacgt
2401 ggaaggaaac aagaaggagg gactattcat gaaggaacag attgatggat ggaacggagc
2461 cacgttggct gctggaaaga tagccaacac agagaaaatt gttatttggg gagatgtgaa
2521 accaaatgaa attttggtta aggcggttc agaacccaa ctggaatgga ctaatgctat
2581 agctacacat gatggcttcc gagatgtggg atttgtttgc agataatgc ttgacaagct
2641 tgttaccgga gtgtttaaag attgtaagac ccctaaaacg tccacattca cacaaagcgg
2701 atttggcttt gacggaatta taactaccac gttagctgtc gcccaaactg aagcctgctc
2761 gatcagcatc tcctgtaaag gatgcacgct tttggcaaca aaagcagtgt tttccgctgg
2821 ggatattgag tcgaagacat gggtgcgatg cggaaacgag agtggaacag cgatcgttgg
```

FIG. 30

```
2881 aggacaagaa gttgccgttg cgtgcgccac aaatcccatc acgcagggat ggagattggt
2941 gaagcatgct actcaacgtt accggaagtt tggaatgcca ggagtaggtg gagtattcca
3001 cgatttagtg ggaacattaa atccatggag tttcttctct accacgactc tggttttcat
3061 ggcggtagtc cttttcatcg tggacaaaag aatcttgatt ttggggatag cttgttatat
3121 gttttatttt gtgcgagccg atactggatg tgccatagat ataagtcggc aagagttgag
3181 gtgtggcagc ggagtattta tacacaatga tgtggaagct tggatggacc gatacaagta
3241 ctaccctgaa acaccacaag gtctagctaa gatcattcaa aaggctcaca aggaaggagt
3301 gtgcggtcta cgatcagttt ctagattgga acaccaaatg tgggaagcag tgaaggatga
3361 actaaacact cttttgaagg aaaatggtgt ggaccttagt attgtggttg agaaacagga
3421 ggggatgtac aaatcagcac ctagacgcct gactgccacc actgagaaac tggaaatagg
3481 ctggaaagcc tgggggaaga gcattctgtt cgcaccagaa ctggccaaca acacttttgt
3541 gattgatggt ccggagacca aggagtgtcc aacccagaac cgtgcctgga acagcttgga
3601 ggtggaagat tttggattcg gcctcaccag cactcggatg ttcttgaggg tcagagaaag
3661 caacacgact gaatgtgact caaagatcat cgggacagcc gtcaagaata acttggcgat
3721 ccatagcgat ctatcctact ggattgaaag caggtttaat gacacgtgga agctcgaaag
3781 ggcggtccta ggtgaagtca aatcatgcac gtggccggaa acacataccc tgtggggtga
3841 cggggtcctt gagagtgacc taataatacc aatcacgcta gcgggactgc gaagcaacca
3901 caaccggagg cctgggtata aaacacaaag ccagggtcca tgggatgaag gtcgagtgga
3961 gattgacttt gattactgtc cagggacaac ggtcactctg agtgagagct gcgggcatcg
4021 tggacctgcc acccgcacca ctacagagag tggaaagctg ataacggact ggtgctgtag
4081 gagctgcacc ttacctccat tgcgctacca gacagacaat ggttgttggt atggcatgga
4141 gattaggcca cagagacatg atgaaaaaac tcttgtgcag tcacaggtga atgcctacaa
4201 cgctgacatg attgatcctt ttcagctggg cctcctggtc gtgttcttgg ccacccagga
4261 ggtccttcgc aagaggtgga cagccaagat cagcatgcca gccatactga ttgccctgct
4321 agttctagtg tttggggggca tcacttacac tgatgtgtta cgctatgtca ttctggtggg
4381 ggcggccttt gcagaatcca actcaggagg agatgtggtg catctggcgc tcatggcaac
4441 cttcaagata caaccagtgt tcatggtagc atcatttctc aaggcgagat ggaccaacca
4501 agaaaacatt ctgctgatgt tggcagctgc tttcttccaa atggcttact atgatgcccg
4561 gcaaattttg ctttgggaaa tgcctgatgt attgaattca ttggcagtgg cttggatgat
4621 attgagagcg ataacgttca ccacaacatc taatgtggtc gtcccgctgc tggccttgtt
4681 aacacctgga ttgagatgcc taaacctgga tgtgtacagg atcctgctac tgatggttgg
4741 aataggcagt ttgatcaggg aaaaaagaag tgcagctgca aaaagaaag gagccagtct
4801 gctatgttg gctctagcct caacaggatt ttttaacccc atgatccttg ctgctggact
4861 tgtcgcatgt gatcccaatc gcaagcgggg gtggcctgca actgaagtga tgacagctgt
4921 cggcttaatg tttgccatcg ttggagggct tgcagaactg gacatagact ccatggccat
4981 tccaatgact atcgcagggc tcatgtttgc tgcttttgtg atctctggaa aatcgaccga
5041 catgtggatt gagaggacag cggacatctc ctgggagggt gatgcggaaa tcacaggttc
5101 cagtgaaaga gttgatgttc ggcttgacga tgacgggaac ttccagctca tgaatgatcc
5161 aggagcacct tggaaaatat ggatgctccg tatggcttgc ctggcaatca gcgcgtacac
5221 ccccttgggct attttgcctt cagtagttgg attttggata actctccaat acacaaagag
5281 aggaggtgtg ctgtgggaca ctccctctcc aaaggagtac aagagagggg acacgaccac
5341 tggtgtctat aggatcatga ctcgtggatt acttggtagt taccaagcag gagcaggcgt
5401 gatggttgaa ggtgttttcc acaccctctg gcacacgaca aaaggagccg ctctgatgag
5461 cggagaaggc cgcctggatc catattgggg cagcgtcaag gaggatcgac tttgttatgg
5521 tggaccctgg aaactgcagc acaagtggaa tggcaagat gaggtgcaaa tgattgtggt
5581 ggaaccaggg aagaatgtca agaacgtcca gactaagccg ggggtgttca aacacctga
5641 aggggagatc ggggccgtga ctctggattt ccccactgga acatcaggct cgcccatagt
5701 ggacaaaaac ggtgatgtga ttggctttta tggcaacggt gtcataatgc ccaatggctc
5761 atacataagc gcgatagtgc aaggtgaaag gatggatgag ccggttcccg ccggattcga
5821 acctgagatg ttgaggaaaa aacagatcac cgtttttgat cttcaccctg gtgctggtaa
5881 aacaaggagg attctgccac agatcatcaa agaggctata aacaggaggc tgaggacggc
```

FIG. 30 cont.

```
5941 tgtgctggcg ccaactaggg ttgtggccgc tgagatggct gaagccctaa gaggattgcc
6001 tatccgatac caaacatctg cggtggccag agagcacaat ggaaatgaga tcgtcgacgt
6061 catgtgccat gcaaccctca cccataggct gatgtctcct catagggtgc ctaattacaa
6121 cctatttgtg atggacgagg cccacttcac cgacccagcc agcatcgcgg ctagaggata
6181 catttccacg agagttgagc tggggggaggc agctgcaata ttcatgactg ccaccccacc
6241 aggtacctca gacccatttc cagagtccaa tgcaccaata tccgacttac agaccgaaat
6301 cccggaccga gcctggaact cagggtatga gtggattaca gaatatatcg ggaagacggt
6361 ttggtttgtg cctagtgtga agatgggaaa tgagatagcc ctctgtctgc agcgcgctgg
6421 caaaaaagtc atccagctaa acagaaagtc gtacgagaca gagtatccaa aatgcaagaa
6481 cgatgattgg gactttgtcg tcacaacaga tatatctgag atgggagcaa actttaaggc
6541 aagcagggtg attgacagcc ggaagagtgt gaaaccgact atcatcacgg aaggagaggg
6601 aagagtgatc ttgggggaac catccgctgt gacggcagcc agtgcagccc agagacgagg
6661 acgcattggt aggaatccat cacaagttgg agatgagtac tgctatggag ggcacacgaa
6721 tgaggatgac tcgaactgtg ctcactggac tgaggcacga atcatgctcg ataacatcaa
6781 catgccaaac ggattgattg ctcaattcta ccaaccagag cgcgagaagg tatacaccat
6841 ggacggggaa taccgactta gaggagagga gaggaaaaac ttcctggaat tgttgagaac
6901 tgcagacttg ccagtatggc tagcttataa ggtggcagca gctggggtgt catatcatga
6961 ccggaggtgg tgttttgatg gccctaggac aaatacaatc cttgaagaca caatgaagt
7021 ggaagtcatc acaaagcttg gtgaaaggaa gattctgagg ccacgctgga ttgatgcaag
7081 ggtgtactca gaccatcagg cgctgaaatc attcaaggac ttcgcctcag ggaagcgctc
7141 tcaaataggt tttatcgagg tccttggaaa gatgcctgaa catttcatgg ggaagacatg
7201 ggaagcactc gacaccatgt atgttgtagc cactgcagag aaaggaggaa gagctcacag
7261 aatggctttg gaggagctac cagacgccct ccaaacaata gctctgatcg ctctgttgag
7321 tgtgatgacc atgggagtgt tttttcttct catgcagagg aagggcatcg gaaagatagg
7381 cctgggaggc gttgtcctgg gagccgcaac cttttttctgt tggatggctg aagtaccagg
7441 aacgaagatt gccggaatgc tgctgctttc cctccttctg atgatcgtgt tgattcctga
7501 gccagagaag caacgctcgc agacagacaa ccagctagct gtgttcctga tttgcgtgtt
7561 gacccttgtg ggtgcggtgg cagccaatga gatgggttgg ctggacaaga ccaagagtga
7621 cataagcggt ctgtttgggc aaagaattga aaccaaggag aattttagca ttggggagtt
7681 cctttttggac ctgaggccgg caacggcttg gtcactgtat gctgtgacta cagcagttct
7741 cactcccttg ctaaagcact tgatcacgtc agactacatc aacacctcat tgacctcaat
7801 aaatgttcaa gctagtgcgc tattcacgct cgcgcgaggc ttcccttttg tcgatgttgg
7861 agtatcggct ctcctgctag cagccggatg ctggggacaa gtcactctca ccgtgacggt
7921 gacatcagca acacttctgt tctgccatta tgcctacatg gtacctggat ggcaggctga
7981 ggcaatgcgc tcagcccagc gacgaacagc cgctggaatc atgaaaaacg ctgtggtaga
8041 cggcatcgtg gccacggacg ttccagagct agagcgtacc acacccatca tgcagaagaa
8101 ggttggacaa gttatgctga ttttggtgtc tcttgccgca ttggtggtaa acccgtctgt
8161 gaagacagtg cgggaagccg gaattctgat tacggcagca gctgttaccc tctgggagaa
8221 cggagcaagc tctgtgtgga acgcaacaac cgcctagga cttgtcaca tcatgcgcgg
8281 aggctggtta tcgtgtttat ccataacatg gactcttgta aaaacatgg aaaaaccagg
8341 gctgaagaga ggtggggcaa aaggacgcac cttgggggag gtttggaaag aaagacttaa
8401 ccagatgacg aaagaagaat tcatcaggta ccgtaaagaa gccatcactg aagttgaccg
8461 ctcagcagca aaacacgcta ggaaggaaag gaatatcact ggagggcatc cagtttctag
8521 aggcacggca aagctaagat ggctggtcga gaggaggttt cttgaaccgg tcggaaaagt
8581 gatcgacctt ggatgtggaa gaggcggctg gtgttattac atggccacac aaaaaaagagt
8641 ccaagaagtc agagggtaca caaaggtgg tcccggacat gaagagcccc agctagtgca
8701 gagctatgga tggaacattg tcaccatgaa gagtggggtg gatgtgttct ataggccttc
8761 tgaatgttgt gacactctcc tttgtgatat cggagagtcc tcatcaagtg ctgaagttga
8821 agaacataga acgctacgag tccttgaaat ggtggaagac tggttgcatc gagggccaaa
8881 ggaattttgt gtgaaggtac tgtgcccta catgccaaag gtcatagaaa agatggagct
8941 gctccaacgc cggtatggcg ggggattggt taggaaccca ctctcacgga attccacaca
```

FIG. 30 cont.

```
9001 tgaaatgtat tgggtgagtc gagcctcagg caatgtggtg cactcagtga acatgaccag
9061 ccaggtactc ttaggaagga tggagaagaa gacctggaag ggacctcagt acgaagaaga
9121 cgtgaacttg ggaagcggaa cgagagcagt gggaaaacct ctactcaact cagacaccag
9181 caagataaag aacaggattg aacgacttag gcgtgagtac agctcgacat ggcatcatga
9241 tgagaaccac ccatatagaa cctggaacta ccacggtagc tacgaagtga agccaacagg
9301 ctctgcaagc tcactggtca atggagtggt caggctcctc tcgaaaccat gggacaccat
9361 cacaaatgtc accacaatgg ccatgacgga caccacccct tttggacaac agcgagtgtt
9421 caaagagaag gtggacacga aagctccgga accgccagaa ggagtgaagt atgtgctcaa
9481 tgaaaccacc aactggttgt gggcgttcct ggcacgagaa aagcgtccca gaatgtgctc
9541 gcgagaggaa tttataagga aggtcaatag taatgcagct ctgggcgcca tgtttgagga
9601 gcagaatcaa tggaggagtg ctagagaagc ggttgaagat ccaaaattct gggaaatggt
9661 ggatgaagag cgtgaggcgc acttacgcgg agaatgtcat acttgcattt acaacatgat
9721 gggaaagagg gagaaaaaac ccggagagtt tgggaaagcc aagggaagca gggccatctg
9781 gtttatgtgg ctgggagctc gcttcctaga gtttgaggct ctgggctttc ttaatgagga
9841 ccactggctt ggaagaaaga actcgggggg cggggtcgag ggtctgggcc tccagaaatt
9901 aggctacatc ctgcgtgaag ttggcacccg acccggaggc agaatctacg ctgatgacac
9961 agccggttgg gacacccgca tcacaagagc tgacctggag aatgaagcca aggttcttga
10021 gttgttggac ggggagcacc ggcgcctggc cagggccatc attgagctca cctatcgcca
10081 caaagtagtg aaggtaatgc gcccggctgc tgatggaaga accgtcatgg acgtcatctc
10141 cagggaagac cagagaggaa gtgggcaagt tgtcacctac gctctaaaca cctttaccaa
10201 cctggctgtc caattggtga aatgatgga aggagagggt gtgatcggcc cagatgatgt
10261 ggagaaactc acaaagggga aagggcccaa ggttagaacc tggctgtctg agaatggga
10321 ggaaagactc agccgcatgg ctgtcagtgg agatgactgt gtggtaaagc ccttggatga
10381 tcgctttgcc acctctctcc actttctcaa cgccatgtca aaggtgcgca aggacatcca
10441 agagtgaaaa ccatcaaccg gatggtatga ttggcagcaa gttccattct gttcaaacca
10501 cttcactgaa ctgatcatga aagatggaag aacactggtg actccatgcc gagggcagga
10561 tgagttagtg ggcagagctc gcatctcccc aggggctgga tggaatgttc gagacactgc
10621 ttgcttagcc aaatcttatg ctcagatgtg gttgctcctg tacttccaca gaagagatct
10681 gcggttgatg gccaacgcca tctgctctgc cgtacctgta aactgggtcc ctactggaag
10741 aaccacatgg tccatccacg ctggaggaga gtggatgaca acggaagaca tgctggaggt
10801 ctggaatcgt gtctggattg aggaaaatga atggatggag gacaaaaccc cagtggagaa
10861 gtggagtgat gttccatact ctggcaaacg agaggacatt tggtgtggca gcctgattgg
10921 cacaagagcc cgggccacgt gggcagaaaa cattcaagtg gccatcaacc aagtcagatc
10981 aataattgga gatgagaaat atgtggatta catgagttca ttgaagagat atgaagacac
11041 aacattggtt gaggatacag tattgtaaat actttgttaa ttgtaaataa atattgttat
11101 tatgtgtaga agtttagctt tataatagtg tttagtgtgt ttagagttag aaaaatttta
11161 gtgaggaagt caggccggaa aattcccgcc accggaagtt gagtagacgg tgctgcctgc
11221 gactcaaccc caggaggact gggtgaacaa agctgcgaag tgatccatgt aagccctcag
11281 aaccgtctcg gaaagaggac cccacatgtt gtagcttcaa ggcccaatgt cagaccacgc
11341 catggcgtgc cactctgcgg agagtgcagt ctgcgacagt gccccaggag gactgggtga
11401 acaaaggcga atcaacgtcc cacgcggccc tagctctggc aatggtgtta accagagtga
11461 aaggactaga ggttagagga gaccccgcgt tctgaagtgc acggcccagc ctggctgaag
11521 ctgtaggtca ggggaaggac tagaggttag tggagacccc gtgccgcaaa acaccacaac
11581 aacacagcat attgacacct gggatagact aggagatctt ctgctctgca caaccagcca
11641 cacggcacag tgcgccgaca atggtggctg gtggtgcgag aacacaggat ct
```

FIG. 30 cont.

>SEQ ID NO:22  WNV$_{KUN}$/BgV-prME chimeric ISF protein

MSKKPGGPGKSRAVNMLKRGMPRVLSLTGLKRAMLSLIDGRGPTRFVLALLAFFRFTAIAPT
RAVLDRWRSVNKQTAMKHLLSFKKELGTLTSAINRSSKQKKRGGKTGIAFMIGLIAGVGA
LTLRKIDNTIVLNVTQNDIGKTFPVRGGNCSININDAGYWCHNTVEYDCVTIAGTEEPDDIDC
WCVGIEGVRVTYGKCSKSSPHGRRSRRAAVIPAHGGQGLSTHKETWLSTVAGERQIQRIER
WIIRNPLYAAAMVTVAYFLGSDTKQKVLLAVLMLAIGPAYGSHCIGIERRDFVHGVQGSTW
VNLVLDQGSCVTMVTENKPSVDVWLKEISLSQPTLVRRYSHTAKVHKTEIKAACPTMGEAK
LDTEHNPSYECKRTYSDRGWGNGCGLFGKGSIIACAEFSSTGHMDVYEIDMTKIEYIVNSQIH
GTVLVENNSQHAVESKFQPTTGGAEVTHAGYGTLGLDCHVQTMMDLNNFYLAVMGSDAW
LVHKQWVEDLTLPWMAGETGHWKEKKYLVEFGEPHATKMEALVLGSQEGALRTALAGA
MVVVYSQNDKKFTLKGGHVSCRARLTDLTLKGTSYPMCKGSLKFTKTPVDTGHGTAVMH
VQVTKGAPCRIGVQMADNSNGGKSLGSMITSNPIVSTDGEETLVEVSPPYGESYIIVGSGDGK
LVYHWHKTGSTIGSLFSETMKGAKRLAILGDDAWDFSSTGGVLASVGKMLHTVFGQAFHAI
FGGLSWISKIILGCVMLWIGVNSRNGTLSVTLLTVGGILLFMTLGVNADTGCAIDISRQELRC
GSGVFIHNDVEAWMDRYKYYPETPQGLAKIIQKAHKEGVCGLRSVSRLEHQMWEAVKDEL
NTLLKENGVDLSIVVEKQEGMYKSAPRRLTATTEKLEIGWKAWGKSILFAPELANNTFVIDG
PETKECPTQNRAWNSLEVEDFGFGLTSTRMFLRVRESNTTECDSKIIGTAVKNNLAIHSDLSY
WIESRFNDTWKLERAVLGEVKSCTWPETHTLWGDGVLESDLIIPITLAGLRSNHNRRPGYKT
QSQGPWDEGRVEIDFDYCPGTTVTLSESCGHRGPATRTTTESGKLITDWCCRSCTLPPLRYQ
TDNGCWYGMEIRPQRHDEKTLVQSQVNAYNADMIDPFQLGLLVVFLATQEVLRKRWTAKI
SMPAILIALLVLVFGGITYTDVLRYVILVGAAFAESNSGGDVVHLALMATFKIQPVFMVASFL
KARWTNQENILLMLAAAFFQMAYYDARQILLWEMPDVLNSLAVAWMILRAITFTTTSNVV
VPLLALLTPGLRCLNLDVYRILLLMVGIGSLIREKRSAAAKKKGASLLCLALASTGFFNPMIL
AAGLVACDPNRKRGWPATEVMTAVGLMFAIVGGLAELDIDSMAIPMTIAGLMFAAFVISGK
STDMWIERTADISWEGDAEITGSSERVDVRLDDDGNFQLMNDPGAPWKIWMLRMACLAIS
AYTPWAILPSVVGFWITLQYTKRGGVLWDTPSPKEYKRGDTTTGVYRIMTRGLLGSYQAGA
GVMVEGVFHTLWHTTKGAALMSGEGRLDPYWGSVKEDRLCYGGPWKLQHKWNGQDEV
QMIVVEPGKNVKNVQTKPGVFKTPEGEIGAVTLDFPTGTSGSPIVDKNGDVIGLYGNGVIMP
NGSYISAIVQGERMDEPVPAGFEPEMLRKKQITVLDLHPGAGKTRRILPQIIKEAINRRLRTAV
LAPTRVVAAEMAEALRGLPIRYQTSAVAREHNGNEIVDVMCHATLTHRLMSPHRVPNYNLF
VMDEAHFTDPASIAARGYISTRVELGEAAAIFMTATPPGTSDPFPESNAPISDLQTEIPDRAWN
SGYEWITEYIGKTVWFVPSVKMGNEIALCLQRAGKKVIQLNRKSYETEYPKCKNDDWDFVV
TTDISEMGANFKASRVIDSRKSVKPTIITEGEGRVILGEPSAVTAASAAQRRGRIGRNPSQVGD
EYCYGGHTNEDDSNCAHWTEARIMLDNINMPNGLIAQFYQPEREKVYTMDGEYRLRGEER
KNFLELLRTADLPVWLAYKVAAAGVSYHDRRWCFDGPRTNTILEDNNEVEVITKLGERKIL
RPRWIDARVYSDHQALKSFKDFASGKRSQIGFIEVLGKMPEHFMGKTWEALDTMYVVATA
EKGGRAHRMALEELPDALQTIALIALLSVMTMGVFFLLMQRKGIGKIGLGGVVLGAATFFC
WMAEVPGTKIAGMLLLSLLLMIVLIPEPEKQRSQTDNQLAVFLICVLTLVGAVAANEMGWL
DKTKSDISGLFGQRIETKENFSIGEFLLDLRPATAWSLYAVTTAVLTPLLKHLITSDYINTSLTS
INVQASALFTLARGFPFVDVGVSALLLAAGCWGQVTLTVTVTSATLLFCHYAYMVPGWQA
EAMRSAQRRTAAGIMKNAVVDGIVATDVPELERTTPIMQKKVGQVMLILVSLAALVVNPSV
KTVREAGILITAAAVTLWENGASSVWNATTAIGLCHIMRGGWLSCLSITWTLVKNMEKPGL
KRGGAKGRTLGEVWKERLNQMTKEEFIRYRKEAITEVDRSAAKHARKERNITGGHPVSRGT
AKLRWLVERRFLEPVGKVIDLGCGRGGWCYYMATQKVQEVRGYTKGGPGHEEPQLVQS
YGWNIVTMKSGVDVFYRPSECCDTLLCDIGESSSSAEVEEHRTLRVLEMVEDWLHRGPKEF
CVKVLCPYMPKVIEKMELLQRRYGGGLVRNPLSRNSTHEMYWVSRASGNVVHSVNMTSQ
VLLGRMEKKTWKGPQYEEDVNLGSGTRAVGKPLLNSDTSKIKNRIERLRREYSSTWHHDEN
HPYRTWNYHGSYEVKPTGSASSLVNGVVRLLSKPWDTITNVTTMAMTDTTPFGQQRVFKE
KVDTKAPEPPEGVKYVLNETTNWLWAFLAREKRPRMCSREEFIRKVNSNAALGAMFEEQN
QWRSAREAVEDPKFWEMVDEEREAHLRGECHTCIYNMMGKREKKPGEFGKAKGSRAIWF
MWLGARFLEFEALGFLNEDHWLGRKNSGGGVEGLGLQKLGYILREVGTRPGGRIYADDTA
GWDTRITRADLENEAKVLELLDGEHRRLARAIIELTYRHKVVKVMRPAADGRTVMDVISRE
DQRGSGQVVTYALNTFTNLAVQLVRMMEGEGVIGPDDVEKLTKGKGPKVRTWLSENGEER
LSRMAVSGDDCVVKPLDDRFATSLHFLNAMSKVRKDIQEWKPSTGWYDWQQVPFCSNHFT
ELIMKDGRTLVTPCRGQDELVGRARISPGAGWNVRDTACLAKSYAQMWLLLYFHRRDLRL
MANAICSAVPVNWVPTGRTTWSIHAGGEWMTTEDMLEVWNRVWIEENEWMEDKTPVEK
WSDVPYSGKREDIWCGSLIGTRARATWAENIQVAINQVRSIIGDEKYVDYMSSLKRYEDTTL
VEDTVL

FIG. 31

SEQ ID NO:23 WNV<sub>KUN</sub>/BgV-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg dacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata aacaatgtat ggtgctaatg ttgcttcaac aacaattctg
 481 ttgaactgtg ttttcatgtt tgccaacaag cacctttata ctcggtggcc tccccaccac
 541 caacttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt ttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtaggggg cccacacggt ttgtgttggc
1201 tctcttggcg ttttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcggag ctcaaaacag aagaagagag gaggaaagac
1381 cggaattgca ttcatgattg gcttgattgc tggcgtggga gcattaactc tcaggaagat
1441 tgacaacact attgttctga atgtcaccca aaatgacata gggaaaacat ttcctgtaag
1501 gggcggtaat tgttccatta acatcaatga tgctggatac tggtgtcaca atacagtcga
1561 atatgattgt gtcaccatag ctggtacgga agagcctgac gacattgatt gctggtgtgt
1621 tggcattgaa ggagtgagag tgacttacgg gaaatgttca aagtcatcac cgcacgggag
1681 gagatctcgt agagcagcag tcattcccgc gcatggtggg cagggactat caacccataa
1741 agagacatgg ctatccactg tagcagggga aaggcaaatc caacgtatag aaagatggat
1801 cattcgcaat cctctttatg ccgctgcaat ggtgactgtg gcgtattttc tgggaagtga
1861 caccaaacag aaagtgctgt tagctgtgtt aatgttggca attggacctg cttacggctc
1921 tcactgcatt ggaattgaac ggcgtgactt tgttcatgga gttcagggaa gcacatgggt
1981 aaatcagtg ctggaccagg atcttgcgt gaccatggtg actgaaaaca gccaagtgt
2041 ggatgtgtgg ctcaaggaaa tctctttgag tcaacccacc ttggttagga gatatagcca
2101 cacagcaaag gtccataaaa cagaaatcaa agctgcttgt cccacaatgg gagaggccaa
2161 acttgatact gaacacaatc cgtcgtatga atgcaagcgc acttattcgg atagaggttg
2221 gggaaacggt tgtggtctgt tcgggaaggg tagcatcatt gcatgcgccg agttttcctc
2281 aacgggccat atggatgttt atgaaattga catgaccaag attgagtaca tcgtgaactc
2341 gcagattcat ggaactgtgc tcgttgagaa caattcccag catgcagtag agtcaaagtt
2401 ccagccaaca acaggaggag ctgaagtcac acatgcaggg tatggcacac ttggcttgga
2461 ctgtcatgta caaaccatga tggatctgaa caacttctat ctggctgtca tgggatccga
2521 tgcatggcta gtgcacaagc aatgggtgga agatttgaca ttaccctgga tggcaggtga
2581 aactggacac tggaaagaaa agaaatatct agttgaattt ggtgaaccac atgccacgaa
2641 gatggaagcc cttgttttag gttccaggag gggggctttg aggactgccc ttgctggagc
2701 tatggtcgtg gtgtactccc aaaatgacaa aaattcact ctgaagggg gtcatgtgag
2761 ttgtagagca agattgactg acctgacatt gaaaggaaca tcatatccaa tgtgcaaggg
2821 ctccctcaag ttcacaaaga ctccagttga caccggacat ggaacagcag tgatgcatgt
2881 gcaagtgacg aaaggggcac catgcagaat aggagtccaa atggctgaca actcaaatgg
2941 aggaaagtcg ttgggaagca tgattacatc aaacccaata gtctccactg atggtgagga
```

FIG. 32

3001 gactctggtt gaagtttctc ccccatatgg agaaagttac atcatagtgg gatcaggcga
3061 tggcaagttg gtttaccatt ggcacaagac tggaagcact attgggagcc tgttctcaga
3121 aaccatgaaa ggagctaaga gattggcaat cctaggtgat gacgcatggg acttctcctc
3181 aacgggaggg gtcttagcct cagttgggaa aatgctgcat actgtgtttg gacaagcttt
3241 ccatgcaatc tttggagggt tgagttggat ttcaaaaata attctaggtt gtgttatgtt
3301 gtggataggt gtgaactccc gcaatggcac attgagtgtc accttgttga ctgttggcgg
3361 cattctgttg ttcatgacac ttggagttaa cgctgatact ggatgtgcca tagatataag
3421 tcggcaagag ttgaggtgtg gcagcggagt atttatacac aatgatgtgg aagcttggat
3481 ggaccgatac aagtactacc ctgaaacacc acaaggtcta gctaagatca ttcaaaaggc
3541 tcacaaggaa ggagtgtgcg gtctacgatc agtttctaga ttggaacacc aaatgtggga
3601 agcagtgaag gatgaactaa acactctttt gaaggaaaat ggtgtggacc ttagtattgt
3661 ggttgagaaa caggaggggga tgtacaaatc agcacctaga cgcctgactg ccaccactga
3721 gaaactggaa ataggctgga aagcctgggg gaagagcatt ctgttcgcac cagaactggc
3781 caacaacact tttgtgattg atggtccgga gaccaaggag tgtccaaccc agaaccgtgc
3841 ctggaacagc ttggaggtgg aagattttgg attcggcctc accagcactc ggatgttctt
3901 gagggtcaga gaaagcaaca cgactgaatg tgactcaaag atcatcggga cagccgtcaa
3961 gaataacttg gcgatccata gcgatctatc ctactggatt gaaagcaggt ttaatgacac
4021 gtggaagctc gaaagggcgg tcctaggtga agtcaaatca tgcacgtggc cggaaacaca
4081 taccctgtgg ggtgacgggg tccttgagag tgacctaata ataccaatca cgctagcggg
4141 actgcgaagc aaccacaacc ggaggcctgg gtataaaaca caaagccagg gtccatggga
4201 tgaaggtcga gtggagattg actttgatta ctgtccaggg acaacggtca ctctgagtga
4261 gagctgcggg catcgtggac ctgccacccg caccactaca gagagtggaa agctgataac
4321 ggactggtgc tgtaggagct gcaccttacc tccattgcgc taccagacag acaatggttg
4381 ttggtatggc atggagatta ggccacagag acatgatgaa aaaactcttg tgcagtcaca
4441 ggtgaatgcc tacaacgctg acatgattga tccttttcag ctgggccttc tggtcgtgtt
4501 cttggccacc caggaggtcc ttcgcaagag gtggacagcc aagatcagca tgccagccat
4561 actgattgcc ctgctagttc tagtgtttgg gggcatcact tacactgatg tgttacgcta
4621 tgtcattctg gtgggggcgg cctttgcaga atccaactca ggaggagatg tggtgcatct
4681 ggcgctcatg gcaaccttca agatacaacc agtgttcatg gtagcatcat ttctcaaggc
4741 gagatggacc aaccaagaaa acattctgct gatgttggca gctgctttct tccaaatggc
4801 ttactatgat gccccggcaaa ttttgctttg ggaaatgcct gatgtattga attcattggc
4861 agtggcttgg atgatattga gagcgataac gttcaccaca acatctaatg tggtcgtccc
4921 gctgctggcc ttgttaacac ctggattgag atgcctaaac ctggatgtgt acaggatcct
4981 gctactgatg gttggaatag gcagtttgat cagggaaaaa agaagtgcag ctgcaaaaaa
5041 gaaaggagcc agtctgctat gtttggctct agcctcaaca ggatttttta accccatgat
5101 ccttgctgct ggacttgtcg catgtgatcc caatcgcaag cgggggtggc ctgcaactga
5161 agtgatgaca gctgtcgggct taatgtttgc catcgttgga gggcttgcag aactggacat
5221 agactccatg gccattccaa tgactatcgc agggctcatg tttgctgctt tgtgatctc
5281 tggaaaatcg accgacatgt ggattgagag gacagcggac atctcctggg agggtgatgc
5341 ggaaatcaca ggttccagtg aaagagttga tgttcggctt gacgatgacg gaacttcca
5401 gctcatgaat gatccaggag caccttggaa aatatggatg ctccgtatgg cttgcctggc
5461 aatcagcgcg tacaccccctt gggctatttt gccttcagta gttggatttt ggataactct
5521 ccaatacaca aagagaggag gtgtgctgtg ggacactccc tctccaaagg agtacaagag
5581 aggggacacg accactggtg tctataggat catgactcgt ggattacttg gtagttacca
5641 agcaggagca ggcgtgatgg ttgaaggtgt tttccacacc ctctggcaca cgacaaaagg
5701 agccgctctg atgagcggag aaggccgcct ggatccatat tgggcagcg tcaaggagga
5761 tcgactttgt tatggtggac cctggaaact gcagcacaag tggaatgggc aagatgaggt
5821 gcaaatgatt gtggtggaac cagggaagaa tgtcaagaac gtccagacta gccgggggt
5881 gttcaaaaca cctgaagggg agatcggggc cgtgactctg gatttcccca ctggaacatc
5941 aggctcgccc atagtggaca aaaacggtga tgtgattggg ctttatggca acggagtcat
6001 aatgcccaat ggctcataca taagcgcgat agtgcaaggt gaaaggatgg atgagccggt

FIG. 32 cont.

6061 tcccgccgga ttcgaacctg agatgttgag gaaaaaacag atcaccgttt tggatcttca
6121 ccctggtgct ggtaaaacaa ggaggattct gccacagatc atcaaagagg ctataaacag
6181 gaggctgagg acggctgtgc tggcgccaac tagggttgtg gccgctgaga tggctgaagc
6241 cctaagagga ttgcctatcc gataccaaac atctgcggtg gccagagagc acaatggaaa
6301 tgagatcgtc gacgtcatgt gccatgcaac cctcacccat aggctgatgt ctcctcatag
6361 ggtgcctaat tacaacctat ttgtgatgga cgaggcccac ttcaccgacc cagccagcat
6421 cgcggctaga ggatacattt ccacgagagt tgagctgggg gaggcagctg caatattcat
6481 gactgccacc ccaccaggta cctcagaccc atttccagag tccaatgcac caatatccga
6541 cttacagacc gaaatcccgg accgagcctg gaactcaggg tatgagtgga ttacagaata
6601 tatcgggaag acggtttggt ttgtgcctag tgtgaagatg ggaaatgaga tagccctctg
6661 tctgcagcgc gctggcaaaa aagtcatcca gctaaacaga aagtcgtacg agacagagta
6721 tccaaaatgc aagaacgatg attgggactt tgtcgtcaca acagatatat ctgagatggg
6781 agcaaacttt aaggcaagca gggtgattga cagccggaag agtgtgaaac cgactatcat
6841 cacggaagga gagggaagag tgatcttggg ggaaccatcc gctgtgacgg cagccagtgc
6901 agcccagaga cgaggacgca ttggtaggaa tccatcacaa gttggagatg agtactgcta
6961 tggagggcac acgaatgagg atgactcgaa ctgtgctcac tggactgagg cacgaatcat
7021 gctcgataac atcaacatgc caaacggatt gattgctcaa ttctaccaac cagagcgcga
7081 gaaggtatac accatggacg gggaataccg acttagagga gaggagagga aaaacttcct
7141 ggaattgttg agaactgcag acttgccagt atggctagct tataaggtgg cagcagctgg
7201 ggtgtcatat catgaccgga ggtggtgttt tgatggccct aggacaaata caatccttga
7261 agacaacaat gaagtggaag tcatcacaaa gcttggtgaa aggaagattc tgaggccacg
7321 ctggattgat gcaagggtgt actcagacca tcaggcgctg aaatcattca aggacttcgc
7381 ctcagggaag cgctctcaaa taggttttat cgaggtcctt ggaaagatgc ctgaacattt
7441 catggggaag acatgggaag cactcgacac catgtatgtt gtagccactg cagagaaagg
7501 aggaagagct cacagaatgg ctttggagga gctaccagac gccctccaaa caatagctct
7561 gatcgctctg ttgagtgtga tgaccatggg agtgttttt cttctcatgc agaggaaggg
7621 catcggaaag ataggcctgg gaggcgttgt cctgggagcc gcaaccttt tctgttggat
7681 ggctgaagta ccaggaacga agattgccgg aatgctgctg ctttccctcc ttctgatgat
7741 cgtgttgatt cctgagccag agaagcaacg ctcgcagaca gacaaccagc tagctgtgtt
7801 cctgatttgc gtgttgaccc ttgtgggtgc ggtggcagcc aatgagatgg gttggctgga
7861 caagaccaag agtgacataa gcggtctgtt tgggcaaaga attgaaacca aggagaattt
7921 tagcattggg gagttccttt tggacctgag gccggcaacg gcttggtcac tgtatgctgt
7981 gactacagca gttctcactc ccttgctaaa gcacttgatc acgtcagact acatcaacac
8041 ctcattgacc tcaataaatg ttcaagctag tgcgctattc acgctcgcgc gaggcttccc
8101 ttttgtcgat gttggagtat cggctctcct gctagcagcc ggatgctggg gacaagtcac
8161 tctcaccgtg acggtgacat cagcaacact tctgttctgc cattatgcct acatggtacc
8221 tggatggcag gctgaggcaa tgcgctcagc ccagcgacga acagccgctg gaatcatgaa
8281 aaacgctgtg gtagacggca tcgtggccac ggacgttcca gagctagagc gtaccacacc
8341 catcatgcag aagaaggttg gacaagttat gctgatttg tgtctcttg ccgcattggt
8401 ggtaaacccg tctgtgaaga cagtgcggga agccggaatt ctgattacgg cagcagctgt
8461 taccctctgg gagaacggag caagctctgt gtggaacgca acaaccgcca taggactttg
8521 tcacatcatg cgcggaggct ggttatcgtg tttatccata acatggactc ttgtaaaaaa
8581 catggaaaaa ccagggctga agagaggtgg ggcaaaagga cgcaccttgg gggaggtttg
8641 gaaagaaaga cttaaccaga tgacgaaaga agaattcatc aggtaccgta agaagccat
8701 cactgaagtt gaccgctcag cagcaaaaca cgctaggaag gaaaggaata tcactggagg
8761 gcatccagtt tctagaggca cggcaaagct aagatggctg tcgagagga ggtttcttga
8821 accggtcgga aaagtgatcg accttggatg tggaagaggc ggctggtgtt attacatggc
8881 cacacaaaaa agagtccaag aagtcagagg gtacacaaaa ggtggtcccg gacatgaaga
8941 gccccagcta gtgcagagct atggatggaa cattgtcacc atgaagagtg gggtggatgt
9001 gttctatagg ccttctgaat gttgtgacac tctcctttgt gatatcggag agtcctcatc
9061 aagtgctgaa gttgaagaac atagaacgct acgagtcctt gaaatggtgg aagactggtt

FIG. 32 cont.

9121 gcatcgaggg ccaaaggaat tttgtgtgaa ggtactgtgc ccctacatgc caaaggtcat
9181 agaaaagatg gagctgctcc aacgccggta tggcggggga ttggttagga acccactctc
9241 acggaattcc acacatgaaa tgtattgggt gagtcgagcc tcaggcaatg tggtgcactc
9301 agtgaacatg accagccagg tactcttagg aaggatggag aagaagacct ggaagggacc
9361 tcagtacgaa gaagacgtga acttgggaag cggaacgaga gcagtgggaa aacctctact
9421 caactcagac accagcaaga taaagaacag gattgaacga cttaggcgtg agtacagctc
9481 gacatggcat catgatgaga accacccata tagaacctgg aactaccacg gtagctacga
9541 agtgaagcca acaggctctg caagctcact ggtcaatgga gtggtcaggc tcctctcgaa
9601 accatgggac accatcacaa atgtcaccac aatggccatg acggacacca cccctttgg
9661 acaacagcga gtgttcaaag agaaggtgga cacgaaagct ccggaaccgc cagaaggagt
9721 gaagtatgtg ctcaatgaaa ccaccaactg gttgtgggcg ttcctggcac gagaaaagcg
9781 tcccagaatg tgctcgcgag aggaatttat aaggaaggtc aatagtaatg cagctctggg
9841 cgccatgttt gaggagcaga atcaatggag gagtgctaga gaagcggttg aagatccaaa
9901 attctgggaa atggtggatg aagagcgtga ggcgcactta cgcggagaat gtcatacttg
9961 catttacaac atgatgggaa agaggagaa aaaacccgga gagtttggga aagccaaggg
10021 aagcagggcc atctggttta tgtggctggg agctcgcttc ctagagtttg aggctctggg
10081 ctttcttaat gaggaccact ggcttggaag aaagaactcg gggggcgggg tcgagggtct
10141 gggcctccag aaattaggct acatcctgcg tgaagttggc acccgacccg gaggcagaat
10201 ctacgctgat gacacagccg gttgggacac ccgcatcaca agagctgacc tggagaatga
10261 agccaaggtt cttgagttgt tggacgggga gcaccggcgc ctggccaggg ccatcattga
10321 gctcacctat cgccacaaag tagtgaaggt aatgcgcccg gctgctgatg gaagaaccgt
10381 catggacgtc atctccaggg aagaccagag aggaagtggg caagttgtca cctacgctct
10441 aaacaccttt accaacctgg ctgtccaatt ggtgagaatg atggaaggag agggtgtgat
10501 cggcccagat gatgtggaga aactcacaaa ggggaaaggg cccaaggtta gaacctggct
10561 gtctgagaat gggaggaaa gactcagccg catggctgtc agtggagatg actgtgtggt
10621 aaagccctg gatgatcgct ttgccacctc tctccacttt ctcaacgcca tgtcaaaggt
10681 gcgcaaggac atccaagagt ggaaaccatc aaccggatgg tatgattggc agcaagttcc
10741 attctgttca aaccacttca ctgaactgat catgaaagat ggaagaacac tggtgactcc
10801 atgccgaggg caggatgagt tagtgggcag agctcgcatc tccccagggg ctggatggaa
10861 tgttcgagac actgcttgct tagccaaatc ttatgctcag atgtggttgc tcctgtactt
10921 ccacagaaga gatctgcggt tgatggccaa cgccatctgc tctgccgtac ctgtaaactg
10981 ggtccctact ggaagaacca catggtccat ccacgctgga ggagagtgga tgacaacgga
11041 agacatgctg gaggtctgga atcgtgtctg gattgaggaa aatgaatgga tggaggacaa
11101 aaccccagtg gagaagtgga gtgatgttcc atactctggc aaacgagagg acatttggtg
11161 tggcagcctg attggcacaa gagcccgggc cacgtgggca gaaaacattc aagtggccat
11221 caaccaagtc agatcaataa ttggagatga gaaatatgtg gattacatga gttcattgaa
11281 gagatatgaa gacacaacat tggttgagga tacagtattg taaatacttt gttaattgta
11341 aataaatatt gttattatgt gtagaagttt agctttataa tagtgtttag tgtgtttaga
11401 gttagaaaaa ttttagtgag gaagtcaggc cggaaaattc ccgccaccgg aagttgagta
11461 gacggtgctg cctgcgactc aaccccagga ggactgggtg aacaaagctg cgaagtgatc
11521 catgtaagcc ctcagaaccg tctcggaaag aggacccac atgttgtagc ttcaaggccc
11581 aatgtcagac cacgccatgg cgtgccactc tgcggagagt gcagtctgcg acagtgcccc
11641 aggaggactg ggtgaacaaa ggcgaatcaa cgtcccacgc ggccctagct ctggcaatgg
11701 tgttaaccag agtgaaagga ctagaggtta gaggagaccc cgcgttctga agtgcacggc
11761 ccagcctggc tgaagctgta ggtcagggga aggactagag gttagtggag accccgtgcc
11821 gcaaaacacc acaacaacac agcatattga cacctgggat agactaggag atcttctgct
11881 ctgcacaacc agccacacgg cacagtgcgc cgacaatggt ggctggtggt gcgagaacac
11941 aggatct

FIG. 32 cont.

>SEQ ID NO:24  WNV$_{KUN}$/BinJV-prME chimeric ISF protein

MSKKPGGPGKSRAVNMLKRGMPRVLSLTGLKRAMLSLIDGRGPTRFVLALLAFFRFTAIA
PTRAVLDRWRSVNKQTAMKHLLSFKKELGTLTSAINRRSSKQKKRGGKTGIAFMIGLIAG
VGAAITIAPHGEAGLRVGSTKHWTSRATPQRYLMRVEKWVLRHPLPALVLVVLGWMMG
RSHGQRAMYIVLMLLVAPSYGNQCLDVQSRDFVQGVSGGTWVDVVLDHDNCITIVADG
KPSFDIRLSKMSMSKFAEYKRYCLQATMSDVTSIVACPGAGDAHNDKSKNHEYICKAVN
NDRGWGNGCVLFGKGSMETCGKFECKKKMAGKLVARENVESVVTVHVHGASATDTKG
VDTASTAKATITPKASVATLNLNDFGSLEVDCSTDVGMDFGEIVVADMSGKWWIVNKDW
FNELALPWSTASTTAEVWQARDRLVEFGWPHAAKQNIYDIGDQEGAVTAAIAQAPMAK
WESDKVELISGILKCKVKLGNLKLRGVTYSMCAQTFTTETRPADTGHGTVAFKVKYVGT
DVPCRVPLHIIDSDGGVAAGRVITAHPFVMKQNDYIILEVEPPFGDSKIEIGTGTTKLVEAW
HRKGSSIGNAFTATYKGITKLTVLGEHAWDFNSLGGFGASLGKAVHTLFGGVFRVMFGG
MGWLTKIFVGAVLVWLGLGAHDKTIATTMILVGSILMYMAVTVGADTGCAIDISRQELRC
GSGVFIHNDVEAWMDRYKYYPETPQGLAKIIQKAHKEGVCGLRSVSRLEHQMWEAVKD
ELNTLLKENGVDLSIVVEKQEGMYKSAPRRLTATTEKLEIGWKAWGKSILFAPELANNTF
VIDGPETKECPTQNRAWNSLEVEDFGFGLTSTRMFLRVRESNTTECDSKIIGTAVKNNLAI
HSDLSYWIESRFNDTWKLERAVLGEVKSCTWPETHTLWGDGVLESDLIIPITLAGLRSNHN
RRPGYKTQSQGPWDEGRVEIDFDYCPGTTVTLSESCGHRGPATRTTTESGKLITDWCCRSC
TLPPLRYQTDNGCWYGMEIRPQRHDEKTLVQSQVNAYNADMIDPFQLGLLVVFLATQEV
LRKRWTAKISMPAILIALLVLVFGGITYTDVLRYVILVGAAFAESNSGGDVVHLALMATFK
IQPVFMVASFLKARWTNQENILLMLAAAFFQMAYYDARQILLWEMPDVLNSLAVAWMIL
RAITFTTTSNVVVPLLALLTPGLRCLNLDVYRILLLMVGIGSLIREKRSAAAKKKGASLLCL
ALASTGFFNPMILAAGLVACDPNRKRGWPATEVMTAVGLMFAIVGGLAELDIDSMAIPMT
IAGLMFAAFVISGKSTDMWIERTADISWEGDAEITGSSERVDVRLDDDGNFQLMNDPGAP
WKIWMLRMACLAISAYTPWAILPSVVGFWITLQYTKRGGVLWDTPSPKEYKRGDTTTGV
YRIMTRGLLGSYQAGAGVMVEGVFHTLWHTTKGAALMSGEGRLDPYWGSVKEDRLCY
GGPWKLQHKWNGQDEVQMIVVEPGKNVKNVQTKPGVFKTPEGEIGAVTLDFPTGTSGSP
IVDKNGDVIGLYGNGVIMPNGSYISAIVQGERMDEPVPAGFEPEMLRKKQITVLDLHPGAG
KTRRILPQIIKEAINRRLRTAVLAPTRVVAAEMAEALRGLPIRYQTSAVAREHNGNEIVDV
MCHATLTHRLMSPHRVPNYNLFVMDEAHFTDPASIAARGYISTRVELGEAAAIFMTATPP
GTSDPFPESNAPISDLQTEIPDRAWNSGYEWITEYIGKTVWFVPSVKMGNEIALCLQRAGK
KVIQLNRKSYETEYPKCKNDDWDFVVTTDISEMGANFKASRVIDSRKSVKPTIITEGEGRVI
LGEPSAVTAASAAQRRGRIGRNPSQVGDEYCYGGHTNEDDSNCAHWTEARIMLDNINMP
NGLIAQFYQPEREKVYTMDGEYRLRGEERKNFLELLRTADLPVWLAYKVAAAGVSYHDR
RWCFDGPRTNTILEDNNEVEVITKLGERKILRPRWIDARVYSDHQALKSFKDFASGKRSQI
GFIEVLGKMPEHFMGKTWEALDTMYVVATAEKGGRAHRMALEELPDALQTIALIALLSV
MTMGVFFLLMQRKGIGKIGLGGVVLGAATFFCWMAEVPGTKIAGMLLLSLLLMIVLIPEP
EKQRSQTDNQLAVFLICVLTLVGAVAANEMGWLDKTKSDISGLFGQRIETKENFSIGEFLL
DLRPATAWSLYAVTTAVLTPLLKHLITSDYINTSLTSINVQASALFTLARGFPFVDVGVSAL
LLAAGCWGQVTLTVTVTSATLLFCHYAYMVPGWQAEAMRSAQRRTAAGIMKNAVVDGI
VATDVPELERTTPIMQKKVGQVMLILVSLAALVVNPSVKTVREAGILITAAAVTLWENGA
SSVWNATTAIGLCHIMRGGWLSCLSITWTLVKNMEKPGLKRGGAKGRTLGEVWKERLNQ
MTKEEFIRYRKEAITEVDRSAAKHARKERNITGGHPVSRGTAKLRWLVERRFLEPVGKVID
LGCGRGGWCYYMATQKRVQEVRGYTKGGPGHEEPQLVQSYGWNIVTMKSGVDVFYRP
SECCDTLLCDIGESSSSAEVEEHRTLRVLEMVEDWLHRGPKEFCVKVLCPYMPKVIEKME
LLQRRYGGGLVRNPLSRNSTHEMYWVSRASGNVVHSVNMTSQVLLGRMEKKTWKGPQ
YEEDVNLGSGTRAVGKPLLNSDTSKIKNRIERLRREYSSTWHHDENHPYRTWNYHGSYEV
KPTGSASSLVNGVVRLLSKPWDTITNVTTMAMTDTTPFGQQRVFKEKVDTKAPEPPEGVK
YVLNETTNWLWAFLAREKRPRMCSREEFIRKVNSNAALGAMFEEQNQWRSAREAVEDP
KFWEMVDEEREAHLRGECHTCIYNMMGKREKKPGEFGKAKGSRAIWFMWLGARFLEFE
ALGFLNEDHWLGRKNSGGGVEGLGLQKLGYILREVGTRPGGRIYADDTAGWDTRITRAD
LENEAKVLELLDGEHRRLARAIIELTYRHKVVKVMRPAADGRTVMDVISREDQRGSGQV
VTYALNTFTNLAVQLVRMMEGEGVIGPDDVEKLTKGKGPKVRTWLSENGEERLSRMAVS
GDDCVVKPLDDRFATSLHFLNAMSKVRKDIQEWKPSTGWYDWQQVPFCSNHFTELIMKD
GRTLVTPCRGQDELVGRARISPGAGWNVRDTACLAKSYAQMWLLLYFHRRDLRLMANA
ICSAVPVNWVPTGRTTWSIHAGGEWMTTEDMLEVWNRVWIEENEWMEDKTPVEKWSD
VPYSGKREDIWCGSLIGTRARATWAENIQVAINQVRSIIGDEKYVDYMSSLKRYEDTTLVE
DTVL

FIG. 33

SEQ ID NO:25    WNV_{KUN}/BinJV-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg acaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata tggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta cgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtagggggg cccacacggt ttgtgttggc
1201 tctcttggcg tttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcggag ctcaaaacag aagaagagag gaggaaagac
1381 cggaattgca ttcatgattg gcttgattgc tggcgtggga gcagcaatca cgatagcccc
1441 gcacggcgaa gcaggattgc gtgttggaag caccaagcat tggacttcta gagcaactcc
1501 acaacggtat ctaatgcgcg ttgagaaatg ggtgctgcgg catcctctac ctgctctcgt
1561 gttggtggta ctgggatgga tgatgggtcg ttctcacggc cagagggcca tgtatatagt
1621 gctgatgctg cttgtggctc cgtcatatgg taaccaatgc ctggatgtgc agtcacgtga
1681 tttcgtgcaa ggggttagtg gtggcacctg ggtagatgtt gttttggatc atgacaattg
1741 cataaccatt gttgctgacg ggaaaccatc ttttgatatt cgtttgtcga aaatgagcat
1801 gtctaaattc gcagagtaca aacggtattg cctccaggcc acgatgagtg atgtcactag
1861 catagtggcg tgtccagggg ctggggatgc tcataatgac aagagcaaaa accacgagta
1921 catttgcaaa gctgttaaca atgaccgcgg atggggcaat gggtgtgtcc ttttttggcaa
1981 aggatcaatg gaaacttgtg gtaagtttga atgtaagaag aaaatggctg gcaagttagt
2041 ggcacgtgag aacgtggaat cagtggtcac tgtgcatgta catggtgcct ccgcaactga
2101 cacaaaagga gttgacaccg cctctacagc caaagcgact atcacgccaa aagcttctgt
2161 ggctactcta aatttaaacg actttggtag cctggaggtg gattgttcaa ctgatgttgg
2221 catggacttt ggagagattg tggtggccga catgtcagga aagtggtgga tcgtgaacaa
2281 ggattggttc aatgaacttg ctttgccgtg gtccacggct agcaccactg ctgaagtttg
2341 gcaggcacga gacagacttg ttgagtttgg atggccacat gcggccaagc agaacatcta
2401 tgacattggg gaccaagaag gagctgtgac ggctgccata gcccaggcac ccatggcgaa
2461 atgggagtct gacaaggtcg agctaatctc tgggattctc aagtgcaagg tgaaacttgg
2521 caacctaaag ctgcgtgggg tgacctatag catgtgtgcc cagacattca ccacggaaac
2581 aaggccggcc gacaccggac atggcactgt ggctttcaag gtgaaatacg tcggaacaga
2641 cgtgccttgc cgggtcccac tccacatcat agacagtgac ggcggagtgg ccgctggacg
2701 agtgataacg gcacaccct tcgtcatgaa gcagaatgat tacattattc tggaagttga
2761 accaccttc ggtgacagca aaattgagat tggaacagga acaacaaaac tcgttgaagc
2821 atggcatcga aaaggtagct cgataggaaa tgcctttacg gccacttaca gggcatcac
2881 aaaattgaca gtgcttggag aacatgcctg ggatttaat tcactaggtg ggtttggagc
2941 aagccttggg aaggcggtcc atacactgtt tggaggtgta ttccgggtga tgttcggagg
```

```
3001 catgggatgg ttaaccaaga tctttgtggg tgctgtccta gtctggctag gattaggagc
3061 tcatgacaag acgatcgcca ccaccatgat cctggtagga tccatactga tgtacatggc
3121 agtgaccgtg ggtgccgata ctggatgtgc catagatata agtcggcaag agttgaggtg
3181 tggcagcgga gtatttatac acaatgatgt ggaagcttgg atggaccgat acaagtacta
3241 ccctgaaaca ccacaaggtc tagctaagat cattcaaaag gctcacaagg aaggagtgtg
3301 cggtctacga tcagtttcta gattggaaca ccaaatgtgg gaagcagtga aggatgaact
3361 aaacactctt ttgaaggaaa atggtgtgga ccttagtatt gtggttgaga acaggagggg
3421 gatgtacaaa tcagcaccta gacgcctgac tgccaccact gagaaactgg aaataggctg
3481 gaaagcctgg gggaagagca ttctgttcgc accagaactg gccaacaaca cttttgtgat
3541 tgatggtccg gagaccaagg agtgtccaac ccagaaccgt gcctggaaca gcttggaggt
3601 ggaagatttt ggattcggcc tcaccagcac tcggatgttc ttgagggtca gagaaagcaa
3661 cacgactgaa tgtgactcaa agatcatcgg gacagccgtc aagaataact ggcgatcca
3721 tagcgatcta tcctactgga ttgaaagcag gtttaatgac acgtggaagc tcgaaagggc
3781 ggtcctaggt gaagtcaaat catgcacgtg gccggaaaca catccctgt ggggtgacgg
3841 ggtccttgag agtgacctaa taataccaat cacgctagcg ggactgcgaa gcaaccacaa
3901 ccggaggcct gggtataaaa cacaaagcca gggtccatgg gatgaaggtc gagtggagat
3961 tgactttgat tactgtccag ggacaacggt cactctgagt gagagctgcg ggcatcgtgg
4021 acctgccacc cgcaccacta cagagagtgg aaagctgata acggactggt gctgtaggag
4081 ctgcaccta cctccattgc gctaccagac agacaatggt tgttggtatg catggagat
4141 taggccacag agacatgatg aaaaaactct tgtgcagtca caggtgaatg cctacaacgc
4201 tgacatgatt gatccttttc agctgggcct tctggtcgtg ttcttggcca cccaggaggt
4261 ccttcgcaag aggtggacag ccaagatcag catgccagcc atactgattg ccctgctagt
4321 tctagtgttt ggggggcatca cttacactga tgtgttacgc tatgtcattc tggtggggc
4381 ggccttttgca gaatccaact caggaggaga tgtggtgcat ctggcgctca tgcaaccctt
4441 caagatacaa ccagtgttca tggtagcatc atttctcaag gcagatgga ccaaccaaga
4501 aaacattctg ctgatgttgg cagctgcttt cttccaaatg gcttactatg atgcccggca
4561 aattttgctt tgggaaatgc ctgatgtatt gaattcattg gcagtggctt ggatgatatt
4621 gagagcgata acgttcacca caacatctaa tgtggtcgtc ccgctgctgg ccttgttaac
4681 acctggattg agatgcctaa acctggatgt gtacaggatc ctgctactga tggttggaat
4741 aggcagttttg atcagggaaa aagaagtgc agctgcaaaa aagaaggag ccagtctgct
4801 atgtttggct ctagcctcaa caggattttt taaccccatg atccttgctg ctggacttgt
4861 cgcatgtgat cccaatcgca agcggggtg gcctgcaact gaagtgatga cagctgtcgg
4921 cttaatgttt gccatcgttg gagggcttgc agaactggac atagactcca tggccattcc
4981 aatgactatc gcagggctca tgttctgctgc ttttgtgatc tctggaaaat cgaccgacat
5041 gtggattgag aggacagcgg acatctcctg ggagggtgat gcggaaatca caggttccag
5101 tgaaagagtt gatgttcggc ttgacgatga cgggaacttc cagctcatga atgatccagg
5161 agcaccttgg aaaatatgga tgctccgtat ggcttgcctg gcaatcagcg cgtcaccc
5221 ttgggctatt ttgccttcag tagttggatt ttggataact ctccaataca caaagagagg
5281 aggtgtgctg tgggacactc cctctccaaa ggagtacaag agaggggaca cgaccactgg
5341 tgtctatagg atcatgactc gtggattact tggtagttac caagcaggag caggcgtgat
5401 ggttgaaggt gttttccaca ccctctggca cacgacaaaa ggagccgctc tgatgagcgg
5461 agaaggccgc ctggatccat attggggcag cgtcaaggag gatcgactt gttatggtgg
5521 accctggaaa ctgcagcaca agtggaatgg gcaagatgag gtgcaaatga ttgtggtgga
5581 accaggaag aatgtcaaga acgtccagac taagccgggg gtgttcaaaa cacctgaagg
5641 ggagatcggg gccgtgactc tggatttccc cactggaaca tcaggctcgc ccatagtgga
5701 caaaaacggt gatgtgattg gctttatgg caacggagtc ataatgccca tggctcata
5761 cataagcgcg atagtgcaag gtgaaaggat ggatgagccg gttcccgccg gattcgaacc
5821 tgagatgttg aggaaaaaac agatcaccgt tttggatctt cacccctggtg ctggtaaaac
5881 aaggaggatt ctgccacaga tcatcaaaga ggctataaac aggaggctga ggacggctgt
5941 gctggcgcca actagggttg tggccgctga gatggctgaa gccctaagag gattgccat
6001 ccgataccaa acatctgcgg tggccagaga gcacaatgga aatgagatcg tcgacgtcat
```

FIG. 34 cont.

```
6061 gtgccatgca accctcaccc ataggctgat gtctcctcat agggtgccta attacaacct
6121 atttgtgatg gacgaggccc acttcaccga cccagccagc atcgcggcta gaggatacat
6181 ttccacgaga gttgagctgg gggaggcagc tgcaatattc atgactgcca ccccaccagg
6241 tacctcagac ccatttccag agtccaatgc accaatatcc gacttacaga ccgaaatccc
6301 ggaccgagcc tggaactcag ggtatgagtg gattacagaa tatatcggga agacggtttg
6361 gtttgtgcct agtgtgaaga tgggaaatga gatagccctc tgtctgcagc gcgctggcaa
6421 aaaagtcatc cagctaaaca gaaagtcgta cgagacagag tatccaaaat gcaagaacga
6481 tgattgggac tttgtcgtca caacagatat atctgagatg ggagcaaact ttaaggcaag
6541 cagggtgatt gacagccgga agagtgtgaa accgactatc atcacggaag gagagggaag
6601 agtgatcttg ggggaaccat ccgctgtgac ggcagccagt gcagcccaga gacgaggacg
6661 cattggtagg aatccatcac aagttggaga tgagtactgc tatggagggc acacgaatga
6721 ggatgactcg aactgtgctc actggactga ggcacgaatc atgctcgata acatcaacat
6781 gccaaacgga ttgattgctc aattctacca accagagcgc gagaaggtat acaccatgga
6841 cggggaatac cgacttagag gagaggagag gaaaaacttc ctggaattgt tgagaactgc
6901 agacttgcca gtatggctag cttataaggt ggcagcagct ggggtgtcat atcatgaccg
6961 gaggtggtgt tttgatggcc ctaggacaaa tacaatcctt gaagacaaca atgaagtgga
7021 agtcatcaca aagcttggtg aaaggaagat tctgaggcca cgctggattg atgcaagggt
7081 gtactcagac catcaggcgc tgaaatcatt caaggacttc gcctcaggga agcgctctca
7141 aataggtttt atcgaggtcc ttggaaagat gcctgaacat ttcatgggga agacatggga
7201 agcactcgac accatgtatg ttgtagccac tgcagagaaa ggaggaagag ctcacagaat
7261 ggctttggag gagctaccag acgccctcca aacaatagct ctgatcgctc tgttgagtgt
7321 gatgaccatg ggagtgtttt ttcttctcat gcagaggaag ggcatcggaa agataggcct
7381 gggaggcgtt gtcctgggag ccgcaaacct tttctgttgg atggctgaag taccaggaac
7441 gaagattgcc ggaatgctgc tgctttccct ccttctgatg atcgtgttga ttcctgagcc
7501 agagaagcaa cgctcgcaga cagacaacca gctagctgtg ttcctgattt gcgtgttgac
7561 ccttgtgggt gcggtggcag ccaatgagat gggttggctg gacaagacca agagtgacat
7621 aagcggtctg tttgggcaaa gaattgaaac caaggagaat tttagcattg gggagttcct
7681 tttggacctg aggccggcaa cggcttggtc actgtatgct gtgactacag cagttctcac
7741 tcccttgcta aagcacttga tcacgtcaga ctacatcaac acctcattga cctcaataaa
7801 tgttcaagct agtgcgctat tcacgctcgc gcgaggcttc ccttttgtcg atgttggagt
7861 atcggctctc ctgctagcag ccggatgctg gggacaagtc actctcaccg tgacggtgac
7921 atcagcaaca cttctgttct gccattatgc ctacatggta cctggatggc aggctgaggc
7981 aatgcgctca gcccagcgac gaacagccgc tggaatcatg aaaaacgctg tggtagacgg
8041 catcgtggcc acggacgttc cagagctaga gcgtaccaca cccatcatgc agaagaaggt
8101 tggacaagtt atgctgattt tggtgtctct tgccgcattg gtggtaaacc cgtctgtgaa
8161 gacagtgcgg gaagccggaa ttctgattac ggcagcagct gttaccctct gggagaacgg
8221 agcaagctct gtgtggaacg caacaaccgc cataggactt tgtcacatca tgcgcggagg
8281 ctggttatcg tgtttatcca taacatggac tcttgtaaaa aacatggaaa aaccagggct
8341 gaagagaggt ggggcaaaag gacgcacctt gggggaggtt tggaaagaaa gacttaacca
8401 gatgacgaaa gaagaattca tcaggtaccg taaagaagcc atcactgaag ttgaccgctc
8461 agcagcaaaa cacgctagga aggaaaggaa tatcactgga gggcatccag tttctagagg
8521 cacggcaaag ctaagatggc tggtcgagag gaggtttctt gaaccggtcg gaaaagtgat
8581 cgaccttgga tgtggaagag gcggctggtg ttattacatg gccacacaaa aaagagtcca
8641 agaagtcaga gggtacacaa aaggtggtcc cggacatgaa gagccccagc tagtgcagag
8701 ctatggatgg aacattgtca ccatgaagag tggggtggat gtgttctata ggcttctga
8761 atgttgtgac actctccttt gtgatatcgg agagtcctca tcaagtgctg aagttgaaga
8821 acatagaacg ctacgagtcc ttgaaatggt ggaagactgg ttgcatcgag ggccaaggga
8881 attttgtgtg aaggtactgt gcccctacat gccaaaggtc atagaaaaga tggagctgct
8941 ccaacgccgg tatggcgggg gattggttag gaacccactc tcacggaatt ccacacatga
9001 aatgtattgg gtgagtcgag cctcaggcaa tgtggtgcac tcagtgaaca tgaccagcca
9061 ggtactctta ggaaggatgg agaagaagac ctggaaggga cctcagtacg aagaagacgt
```

FIG. 34 cont.

```
9121 gaacttggga agcggaacga gagcagtggg aaaacctcta ctcaactcag acaccagcaa
9181 gataaagaac aggattgaac gacttaggcg tgagtacagc tcgacatggc atcatgatga
9241 gaaccaccca tatagaacct ggaactacca cggtagctac gaagtgaagc caacaggctc
9301 tgcaagctca ctggtcaatg gagtggtcag gctcctctcg aaaccatggg acaccatcac
9361 aaatgtcacc acaatggcca tgacggacac caccccttt ggacaacagc gagtgttcaa
9421 agagaaggtg gacacgaaag ctccggaacc gccagaagga gtgaagtatg tgctcaatga
9481 aaccaccaac tggttgtggg cgttcctggc acgagaaaag cgtcccagaa tgtgctcgcg
9541 agaggaattt ataaggaagg tcaatagtaa tgcagctctg ggcgccatgt ttgaggagca
9601 gaatcaatgg aggagtgcta gagaagcggt tgaagatcca aaattctggg aaatggtgga
9661 tgaagagcgt gaggcgcact tacgcggaga atgtcatact tgcatttaca acatgatggg
9721 aaagagggag aaaaaacccg gagagtttgg gaaagccaag ggaagcaggg ccatctggtt
9781 tatgtggctg ggagctcgct tcctagagtt tgaggctctg ggctttctta atgaggacca
9841 ctggttgga agaaagaact cgggggggcgg ggtcgagggt ctgggcctcc agaaattagg
9901 ctacatcctg cgtgaagttg gcacccgacc cggaggcaga atctacgctg atgacacagc
9961 cggttgggac acccgcatca caagagctga cctggagaat gaagccaagg ttcttgagtt
10021 gttggacggg gagcaccggc gcctggccag ggccatcatt gagctcacct atcgccacaa
10081 agtagtgaag gtaatgcgcc cggctgctga tggaagaacc gtcatggacg tcatctccag
10141 ggaagaccag agaggaagtg ggcaagttgt cacctacgct ctaaacacct ttaccaacct
10201 ggctgtccaa ttggtgagaa tgatggaagg agagggtgtg atcggcccag atgatgtgga
10261 gaaactcaca aagggaaag ggccaaggt tagaacctgg ctgtctgaga atggggagga
10321 aagactcagc cgcatggctg tcagtggaga tgactgtgtg gtaaagccct tggatgatcg
10381 ctttgccacc tctctccact ttctcaacgc catgtcaaag gtgcgcaagg acatccaaga
10441 gtggaaacca tcaaccggat ggtatgattg gcagcaagtt ccattctgtt caaaccactt
10501 cactgaactg atcatgaaag atggaagaac actggtgact ccatgccgag ggcaggatga
10561 gttagtgggc agagctcgca tctccccagg ggctggatgg aatgttcgag acactgcttg
10621 cttagccaaa tcttatgctc agatgtggtt gctcctgtac ttccacagaa gagatctgcg
10681 gttgatggcc aacgccatct gctctgccgt acctgtaaac tgggtcccta ctggaagaac
10741 cacatggtcc atccacgctg gaggagagtg gatgacaacg gaagacatgc tggaggtctg
10801 gaatcgtgtc tggattgagg aaaatgaatg gatggaggac aaaacccag tggagaagtg
10861 gagtgatgtt ccatactctg gcaaacgaga ggacatttgg tgtggcagcc tgattggcac
10921 aagagcccgg gccacgtggg cagaaaacat tcaagtggcc atcaaccaag tcagatcaat
10981 aattggagat gagaaatatg tggattacat gagttcattg aagagatatg aagacacaac
11041 attggttgag gatacagtat tgtaaatact ttgttaattg taaataaata ttgttattat
11101 gtgtagaagt ttagctttat aatagtgttt agtgtgttta gagttagaaa aattttagtg
11161 aggaagtcag gccggaaaat tcccgccacc ggaagttgag tagacggtgc tgcctgcgac
11221 tcaaccccag gaggactggg tgaacaaagc tgcgaagtga tccatgtaag ccctcagaac
11281 cgtctcggaa agaggacccc acatgttgta gcttcaaggc ccaatgtcag accacgccat
11341 ggcgtgccac tctgcggaga gtgcagtctg cgacagtgcc ccaggaggac tgggtgaaca
11401 aaggcgaatc aacgtcccac gcggcccag ctctggcaat ggtgttaacc agagtgaaag
11461 gactagaggt tagaggagac cccgcgttct gaagtgcacg gcccagcctg gctgaagctg
11521 taggtcaggg gaaggactag aggttagtgg agaccccgtg ccgcaaaaca ccacaacaac
11581 acagcatatt gacacctggg atagactagg agatcttctg ctctgcacaa ccagccacac
11641 ggcacagtgc gccgacaatg gtggctggtg gtgcgagaac acaggatct
```

FIG. 34 cont.

>SEQ ID NO:26 WNV$_{KUN}$/CFAV-prME chimeric ISF protein
MSKKPGGPGKSRAVNMLKRGMPRVLSLTGLKRAMLSLIDGRGPTRFVLALLAFFRFTAIA
PTRAVLDRWRSVNKQTAMKHLLSFKKELGTLTSAINRRSSKQKKRGGKTGIAFMIGLIAG
VGAVVIDMQVSTTRGTEIFEGETNRTDYLHLLKLPADGCWSGILVTKKCPKVTDLAKDLE
STDCGSTWTEFTLRYRRCVVKKREKRSREPPKADLLAEMEIIAFKTIRENKTIFIVALLCVAI
AKRWPTWVVILLAIGTWTTVKGEFVEPLYTLKAEQMTMLQTIVRPEEGYVVATPNGLLEF
KTGPAEIYGGQWLRELLADCHVNASYSTDVCPGGSQLNMADIMAKERVCSTQPYNRGW
GTGCFKWGIGFVGTCVELHCDRGFNVSSIARSAIVMNVTASFHSVSDTQQMVGDIPLTFRF
AKLGNAAMTCRLESEQLLLDYYHVTGSSHEGLFLRSQVDSWPGVHSTASGRHGMEKVV
VWGDARSNEILVKNVIEPSLSWEDAIATHGGFRDISFVCQIMLDKLVSGAFRDCPGPKISTF
SQDGFGYSGVVITTLTASSNETCSLSLTCHGCLLQSTKMIFLAGKTTSRAFVKCGNHTSTLL
VGSTSVSIECALNPISQGWRLARHVVDRYRRFGVSGVAGVWQDLVGKFSVGAFFSNTALL
VILVLAALIDKRIAFLLVLGGYFYYVRADTGCAIDISRQELRCGSGVFIHNDVEAWMDRYK
YYPETPQGLAKIIQKAHKEGVCGLRSVSRLEHQMWEAVKDELNTLLKENGVDLSIVVEKQ
EGMYKSAPRRLTATTEKLEIGWKAWGKSILFAPELANNTFVIDGPETKECPTQNRAWNSL
EVEDFGFGLTSTRMFLRVRESNTTECDSKIIGTAVKNNLAIHSDLSYWIESRFNDTWKLER
AVLGEVKSCTWPETHTLWGDGVLESDLIIPITLAGLRSNHNRRPGYKTQSQGPWDEGRVEI
DFDYCPGTTVTLSESCGHRGPATRTTTESGKLITDWCCRSCTLPPLRYQTDNGCWYGMEI
RPQRHDEKTLVQSQVNAYNADMIDPFQLGLLVVFLATQEVLRKRWTAKISMPAILIALLV
LVFGGITYTDVLRYVILVGAAFAESNSGGDVVHLALMATFKIQPVFMVASFLKARWTNQE
NILLMLAAAFFQMAYYDARQILLWEMPDVLNSLAVAWMILRAITFTTTSNVVVPLLALLT
PGLRCLNLDVYRILLLMVGIGSLIREKRSAAAKKKGASLLCLALASTGFFNPMILAAGLVA
CDPNRKRGWPATEVMTAVGLMFAIVGGLAELDIDSMAIPMTIAGLMFAAFVISGKSTDM
WIERTADISWEGDAEITGSSERVDVRLDDDGNFQLMNDPGAPWKIWMLRMACLAISAYT
PWAILPSVVGFWITLQYTKRGGVLWDTPSPKEYKRGDTTTGVYRIMTRGLLGSYQAGAG
VMVEGVFHTLWHTTKGAALMSGEGRLDPYWGSVKEDRLCYGGPWKLQHKWNGQDEV
QMIVVEPGKNVKNVQTKPGVFKTPEGEIGAVTLDFPTGTSGSPIVDKNGDVIGLYGNGVIM
PNGSYISAIVQGERMDEPVPAGFEPEMLRKKQITVLDLHPGAGKTRRILPQIIKEAINRRLRT
AVLAPTRVVAAEMAEALRGLPIRYQTSAVAREHNGNEIVDVMCHATLTHRLMSPHRVPN
YNLFVMDEAHFTDPASIAARGYISTRVELGEAAAIFMTATPPGTSDPFPESNAPISDLQTEIP
DRAWNSGYEWITEYIGKTVWFVPSVKMGNEIALCLQRAGKKVIQLNRKSYETEYPKCKN
DDWDFVVTTDISEMGANFKASRVIDSRKSVKPTIITEGEGRVILGEPSAVTAASAAQRRGRI
GRNPSQVGDEYCYGGHTNEDDSNCAHWTEARIMLDNINMPNGLIAQFYQPEREKVYTMD
GEYRLRGEERKNFLELLRTADLPVWLAYKVAAAGVSYHDRRWCFDGPRTNTILEDNNEV
EVITKLGERKILRPRWIDARVYSDHQALKSFKDFASGKRSQIGFIEVLGKMPEHFMGKTWE
ALDTMYVVATAEKGGRAHRMALEELPDALQTIALIALLSVMTMGVFFLLMQRKGIGKIG
LGGVVLGAATFFCWMAEVPGTKIAGMLLLSLLLMIVLIPEPEKQRSQTDNQLAVFLICVLT
LVGAVAANEMGWLDKTKSDISGLFGQRIETKENFSIGEFLLDLRPATAWSLYAVTTAVLT
PLLKHLITSDYINTSLTSINVQASALFTLARGFPFVDVGVSALLLAAGCWGQVTLTVTVTS
ATLLFCHYAYMVPGWQAEAMRSAQRRTAAGIMKNAVVDGIVATDVPELERTTPIMQKK
VGQVMLILVSLAALVVNPSVKTVREAGILITAAAVTLWENGASSVWNATTAIGLCHIMRG
GWLSCLSITWTLVKNMEKPGLKRGGAKGRTLGEVWKERLNQMTKEEFIRYRKEAITEVD
RSAAKHARKERNITGGHPVSRGTAKLRWLVERRFLEPVGKVIDLGCGRGGWCYYMATQ
KRVQEVRGYTKGGPGHEEPQLVQSYGWNIVTMKSGVDVFYRPSECCDTLLCDIGESSSSA
EVEEHRTLRVLEMVEDWLHRGPKEFCVKVLCPYMPKVIEKMELLQRRYGGGLVRNPLSR
NSTHEMYWVSRASGNVVHSVNMTSQVLLGRMEKKTWKGPQYEEDVNLGSGTRAVGKP
LLNSDTSKIKNRIERLRREYSSTWHHDENHPYRTWNYHGSYEVKPTGSASSLVNGVVRLL
SKPWDTITNVTTMAMTDTTPFGQQRVFKEKVDTKAPEPPEGVKYVLNETTNWLWAFLAR
EKRPRMCSREEFIRKVNSNAALGAMFEEQNQWRSAREAVEDPKFWEMVDEEREAHLRGE
CHTCIYNMMGKREKKPGEFGKAKGSRAIWFMWLGARFLEFEALGFLNEDHWLGRKNSG
GGVEGLGLQKLGYILREVGTRPGGRIYADDTAGWDTRITRADLENEAKVLELLDGEHRRL
ARAIIELTYRHKVVKVMRPAADGRTVMDVISREDQRGSGQVVTYALNTFTNLAVQLVRM
MEGEGVIGPDDVEKLTKGKGPKVRTWLSENGEERLSRMAVSGDDCVVKPLDDRFATSLH
FLNAMSKVRKDIQEWKPSTGWYDWQQVPFCSNHFTELIMKDGRTLVTPCRGQDELVGRA
RISPGAGWNVRDTACLAKSYAQMWLLLYFHRRDLRLMANAICSAVPVNWVPTGRTTWSI
HAGGEWMTTEDMLEVWNRVWIEENEWMEDKTPVEKWSDVPYSGKREDIWCGSLIGTRA
RATWAENIQVAINQVRSIIGDEKYVDYMSSLKRYEDTTLVEDTVL

FIG. 35

SEQ ID NO:27 WNV$_{KUN}$/CFAV-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag cacctttata ctcggtggcc tccccaccac
 541 caacttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt ttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtaggggg cccacacggt ttgtgttggc
1201 tctcttggcg ttttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcgag ctcaaaacag aagaagagag gaggaaagac
1381 cggaattgca ttcatgattg gcttgattgc tggcgtggga gcagtggtga ttgacatgca
1441 agtttctacc actagaggca cggaaatttt tgaaggggag acgaaccgga cagactactt
1501 gcatctgctc aagttacccg ctgatggttg ctggagtggc atccttgtca caaagaagtg
1561 cccaaaagtg actgacttgg caaaggacct cgagtcgaca gattgcggat caacgtggac
1621 tgagttcaca ttgcggtatc ggagatgcgt cgtgaagaaa cgtgaaaagc gatcacgtga
1681 acccccgaaa gcggatttgc tagctgaaat ggagatcatt gcgttcaaga ccattcgcga
1741 aaataagaca atcttcatcg tggcccctat tgtgtgtggct atcgcgaagc gttggcccac
1801 ctgggttgtg attcttctgg caattggcac ttggaccaca gtaaagggg agtttgttga
1861 accgttatac acgctgaaag cggaacagat gaccatgcta cagaccatcg tgagaccgga
1921 ggaagggtac gtcgtggcca cgccaaacgg tctcctcgag tttaaaacag gaccggcgga
1981 gatctacggg gggcaatggc tgcgcgagtt actcgcagat tgccacgtca acgcatccta
2041 ttcgactgac gtgtgtcccg gtggatcgca gctcaacatg gcagatatca tggccaagga
2101 acgagtatgc tcgacccaac catacaaccg cggttggggc actgggtgct tcaagtgggg
2161 gattggattc gttggaacgt gcgtcgaact ccattgcgac agaggattca acgtttcttc
2221 tatcgctagg tcagctattg ttatgaacgt tacggctagc ttccactccg ttagtgacac
2281 acaacagatg gttggcgaca taccgctcac atttaggttt gcgaaactcg gaaacgcggc
2341 gatgacctgc aggttggagt ctgagcagtt gctgcttgat tactatcatg ttacgggaag
2401 ctcccatgag gggctgtttt tgcggtctca agttgacagt tggcctggcg tgcactctac
2461 tgctagtggt cggcacggca tggagaaagt tgttgtgtgg ggagatgcta ggtccaatga
2521 gattctagta aaaacgtaa ttgaaccttc gttgtcctgg gaagacgcga tcgccactca
2581 tggtggattc cgtgacatct cctttgtttg tcagattatg ctcgacaaac tagtcagtgg
2641 agcttttcga gattgtccag gcccaaaaat atccactttt tcccaggacg gcttcgggta
2701 tagtggagtg gtgataacca ccctcaccgc ttcttctaat gagacctgtt cgcttagctt
2761 aacgtgtcac ggttgtctgc tgcaatccac aaaatgatc tttctcgcag ggaagaccac
2821 ttctcgggca tttgtcaagt gcgggaacca tacaagcacc ttgctcgttg ggagcacttc
2881 agtttctatt gagtcgcccc ttaaccctat ctcgcaagga tggcgcctag cccgacacgt
2941 ggtggatcgg tatcgacggt ttggcgtgtc tggtgttgcg ggagtgtggc aggatctggt
```

FIG. 36

```
3001 cggaaagttt tcggttggtg ccttcttctc caacacagcc cttctggtca ttctcgtcct
3061 cgctgccttg attgacaaac gcatagcctt tctattggtt ttagggggt acttttacta
3121 tgtgcgggct gatactggat gtgccataga tataagtcgg caagagttga ggtgtggcag
3181 cggagtattt atacacaatg atgtggaagc ttggatggac cgatacaagt actaccctga
3241 aacaccacaa ggtctagcta agatcattca aaaggctcac aaggaaggag tgtgcggtct
3301 acgatcagtt tctagattgg aacaccaaat gtgggaagca gtgaaggatg aactaaacac
3361 tcttttgaag gaaaatggtg tggaccttag tattgtggtt gagaaacagg aggggatgta
3421 caaatcagca cctagacgcc tgactgccac cactgagaaa ctggaaatag gctggaaagc
3481 ctgggggaag agcattctgt tcgcaccaga actggccaac aacacttttg tgattgatgg
3541 tccggagacc aaggagtgtc caacccagaa ccgtgcctgg aacagcttgg aggtggaaga
3601 ttttggattc ggcctcacca gcactcggat gttcttgagg gtcagagaaa gcaacacgac
3661 tgaatgtgac tcaaagatca tcgggacagc cgtcaagaat aacttggcga tccatagcga
3721 tctatcctac tggattgaaa gcaggtttaa tgacacgtgg aagctcgaaa gggcggtcct
3781 aggtgaagtc aaatcatgca cgtggccgga aacacatacc ctgtggggtg acggggtcct
3841 tgagagtgac ctaataatac caatcacgct agcgggactg cgaagcaacc acaaccggag
3901 gcctgggtat aaaacacaaa gccagggtcc atgggatgaa ggtcgagtgg agattgactt
3961 tgattactgt ccagggacaa cggtcactct gagtgagagc tgcgggcatc gtggacctgc
4021 cacccgcacc actacagaga gtggaaagct gataacggac tggtgctgta ggagctgcac
4081 cttacctcca ttgcgctacc agacagacaa tggttgttgg tatggcatgg agattaggcc
4141 acagagacat gatgaaaaaa ctcttgtgca gtcacaggtg aatgcctaca acgctgacat
4201 gattgatcct tttcagctgg gccttctggt cgtgttcttg gccacccagg aggtccttcg
4261 caagaggtgg acagccaaga tcagcatgcc agccatactg attgccctgc tagttctagt
4321 gtttgggggc atcacttaca ctgatgtgtt acgctatgtc attctggtgg gggcggcctt
4381 tgcagaatcc aactcaggag gagatgtggt gcatctggcg ctcatggcaa ccttcaagat
4441 acaaccagtg ttcatggtag catcatttct caaggcgaga tggaccaacc aagaaaacat
4501 tctgctgatg ttggcagctg ctttcttcca aatggcttac tatgatgccc ggcaaatttt
4561 gctttgggaa atgcctgatg tattgaattc attggcagtg gcttggatga tattgagagc
4621 gataacgttc accacaacat ctaatgtggt cgtcccgctg ctggccttgt taacacctgg
4681 attgagatgc ctaaacctgg atgtgtacag gatcctgcta ctgatggttg gaataggcag
4741 tttgatcagg gaaaaagaa gtgcagctgc aaaaaagaaa ggagccagtc tgctatgttt
4801 ggctctagcc tcaacaggat tttttaaccc catgatcctt gctgctggac ttgtcgcatg
4861 tgatcccaat cgcaagcggg ggtggcctgc aactgaagtg atgacagctg tcggcttaat
4921 gtttgccatc gttggagggc ttgcagaact ggacatagac tccatggcca ttccaatgac
4981 tatcgcaggg ctcatgtttg ctgcttttgt gatctctgga aaatcgaccg acatgtggat
5041 tgagaggaca gcggacatct cctgggaggg tgatgcggaa atcacaggtt ccagtgaaag
5101 agttgatgtt cggcttgacg atgacgggaa cttccagctc atgaatgatc caggagcacc
5161 ttggaaaata tggatgctcc gtatggcttg cctggcaatc agcgcgtaca ccccttgggc
5221 tattttgcct tcagtagttg gattttggat aactctccaa tacacaaaga gaggaggtgt
5281 gctgtgggac actccctctc caaaggagta caagagaggg gacacgacca ctggtgtcta
5341 taggatcatg actcgtggat tacttggtag ttaccaagca ggagcaggcg tgatggttga
5401 aggtgtttc cacacccctc ggcacacgac aaaaggagcc gctctgatga gcggagaagg
5461 ccgcctggat ccatattggg gcagcgtcaa ggaggatcga ctttgttatg gtggaccctg
5521 gaaactgcag cacaagtgga atggggcaaga tgaggtgcaa atgattgtgg tggaaccagg
5581 gaagaatgtc aagaacgtcc agactaagcc gggggtgttc aaaacacctg aaggggagat
5641 cggggccgtg actctggatt tcccactgg aacatcaggc tcgcccatag tggacaaaaa
5701 cggtgatgtg attgggcttt atggcaacgg agtcataatg cccaatggct catacataag
5761 cgcgatagtg caaggtgaaa ggatggatga gccggttccc gccggattcg aacctgagat
5821 gttgaggaaa aaacagatca ccgttttgga tcttcaccct ggtgctggta aaacaaggag
5881 gattctgcca cagatcatca aagaggctat aaacaggagg ctgaggacg ctgtgctggc
5941 gccaactagg gttgtggccg ctgagatggc tgaagcccta agaggattgc ctatccgata
6001 ccaaacatct gcggtggcca gagagcacaa tggaaatgag atcgtcgacg tcatgtgcca
```

FIG. 36 cont.

```
6061 tgcaaccctc acccataggc tgatgtctcc tcataggggtg cctaattaca acctatttgt
6121 gatggacgag gcccacttca ccgacccagc cagcatcgcg gctagaggat acatttccac
6181 gagagttgag ctgggggagg cagctgcaat attcatgact gccacccccac caggtacctc
6241 agacccattt ccagagtcca atgcaccaat atccgactta cagaccgaaa tcccggaccg
6301 agcctggaac tcagggtatg agtggattac agaatatatc gggaagacgg tttggtttgt
6361 gcctagtgtg aagatgggaa atgagatagc cctctgtctg cagcgcgctg gcaaaaaagt
6421 catccagcta aacagaaagt cgtacgagac agagtatcca aaatgcaaga acgatgattg
6481 ggactttgtc gtcacaacag atatatctga gatgggagca aactttaagg caagcagggt
6541 gattgacagc cggaagagtg tgaaaccgac tatcatcacg gaaggagagg gaagagtgat
6601 cttgggggaa ccatccgctg tgacggcagc cagtgcagcc cagagacgag gacgcattgg
6661 taggaatcca tcacaagttg gagatgagta ctgctatgga gggcacacga atgaggatga
6721 ctcgaactgt gctcactgga ctgaggcacg aatcatgctc gataacatca acatgccaaa
6781 cggattgatt gctcaattct accaaccaga gcgcgagaag gtatacacca tggacgggga
6841 ataccgactt agaggagagg agaggaaaaa cttcctggaa ttgttgagaa ctgcagactt
6901 gccagtatgg ctagcttata aggtggcagc agctggggtg tcatatcatg accggaggtg
6961 gtgttttgat ggccctagga caaatacaat ccttgaagac aacaatgaag tggaagtcat
7021 cacaaagctt ggtgaaagga agattctgag gccacgctgg attgatgcaa gggtgtactc
7081 agaccatcag gcgctgaaat cattcaagga cttcgcctca gggaagcgct ctcaaatagg
7141 ttttatcgag gtccttggaa agatgcctga acatttcatg gggaagacat gggaagcact
7201 cgacaccatg tatgttgtag ccactgcaga gaaaggagga agagctcaca gaatggcttt
7261 ggaggagcta ccagacgccc tccaaacaat agctctgatc gctctgttga gtgtgatgac
7321 catgggagtg tttttttcttc tcatgcagag gaagggcatc ggaaagatag gcctgggagg
7381 cgttgtcctg ggagccgcaa ccttttttctg ttggatggct gaagtaccag gaacgaagat
7441 tgccggaatg ctgctgcttt ccctccttct gatgatcgtg ttgattcctg agccagaaa
7501 gcaacgctcg cagacagaca accagctagc tgtgttcctg atttgcgtgt tgaccttgt
7561 gggtgcggtg gcagccaatg agatggggttg gctggacaag accaagagtg acataagcgg
7621 tctgtttggg caaagaattg aaaccaagga gaattttagc attggggagt tccttttgga
7681 cctgaggccg gcaacggctt ggtcactgta tgctgtgact acagcagttc tcactccctt
7741 gctaaagcac ttgatcacgt cagactacat caacacctca ttgacctcaa taaatgttca
7801 agctagtgcg ctattcacgc tcgcgcgagg cttccctttt gtcgatgttg gagtatcggc
7861 tctcctgcta gcagccggat gctggggaca agtcactctc accgtgacgg tgacatcagc
7921 aacacttctg ttctgccatt atgcctacat ggtacctgga tggcaggctg aggcaatgcg
7981 ctcagcccag cgacgaacag ccgctggaat catgaaaaac gctgtggtag acggcatcgt
8041 ggccacggac gttccagagc tagagcgtac cacacccatc atgcagaaga aggttggaca
8101 agttatgctg attttggtgt ctcttgccgc attggtggta aacccgtctg tgaagacagt
8161 gcgggaagcc ggaattctga ttacggcagc agctgttacc ctctgggaga acggagcaag
8221 ctctgtgtgg aacgcaacaa ccgccatagg actttgtcac atcatgcgcg gaggctggtt
8281 atcgtgttta tccataacat ggactcttgt aaaaaacatg gaaaaaccag ggctgaagag
8341 aggtggggca aaaggacgca cctttgggga ggtttggaaa gaaagactta accagatgac
8401 gaaagaagaa ttcatcaggt accgtaaaga agccatcact gaagttgacc gctcagcagc
8461 aaaacacgct aggaaggaaa ggaatatcac tggagggcat ccagttttcta gaggcacggc
8521 aaagctaaga tggctggtcg agaggaggtt tcttgaaccg gtcggaaaag tgatcgacct
8581 tggatgtgga gaggcggct ggtgttatta catggccaca caaaaaaagag tccaagaagt
8641 cagagggtac acaaaaggtg gtcccggaca tgaagagccc cagctagtgc agagctatgg
8701 atggaacatt gtcaccatga agagtggggt ggatgtgttc tataggcctt ctgaatgttg
8761 tgacactctc ctttgtgata tcggagagtc ctcatcaagt gctgaagttg aagaacatag
8821 aacgctacga gtccttgaaa tggtgaaaga ctggtttcat cgagggccaa aggaattttg
8881 tgtgaaggta ctgtgcccct acatgccaaa ggtcatagaa aagatggagc tgctccaacg
8941 ccggtatggc gggggattgg ttaggaaccc actctcacgg aattccacac atgaaatgta
9001 ttgggtgagt cgagcctcag gcaatgtggt gcactcagtg aacatgacca gccaggtact
9061 cttaggaagg atggagaaga agacctggaa gggacctcag tacgaagaag acgtgaactt
```

FIG. 36 cont.

```
9121 gggaagcgga acgagagcag tgggaaaacc tctactcaac tcagacacca gcaagataaa
9181 gaacaggatt gaacgactta ggcgtgagta cagctcgaca tggcatcatg atgagaacca
9241 cccatataga acctggaact accacggtag ctacgaagtg aagccaacag gctctgcaag
9301 ctcactggtc aatggagtgg tcaggctcct ctcgaaacca tgggacacca tcacaaatgt
9361 caccacaatg gccatgacgg acaccacccc ttttggacaa cagcgagtgt tcaaagagaa
9421 ggtggacacg aaagctccgg aaccgccaga aggagtgaag tatgtgctca atgaaaccac
9481 caactggttg tgggcgttcc tggcacgaga aaagcgtccc agaatgtgct cgcgagagga
9541 atttataagg aaggtcaata gtaatgcagc tctgggcgcc atgtttgagg agcagaatca
9601 atggaggagt gctagagaag cggttgaaga tccaaaattc tgggaaatgg tggatgaaga
9661 gcgtgaggcg cacttacgcg gagaatgtca tacttgcatt tacaacatga tgggaaagag
9721 ggagaaaaaa cccggagagt ttgggaaagc caagggaagc agggccatct ggtttatgtg
9781 gctgggagct cgcttcctag agtttgaggc tctgggcttt cttaatgagg accactggct
9841 tggaagaaag aactcggggg gcggggtcga gggtctgggc ctccagaaat taggctacat
9901 cctgcgtgaa gttggcaccc gacccggagg cagaatctac gctgatgaca cagccggttg
9961 ggacacccgc atcacaagag ctgacctgga gaatgaagcc aaggttcttg agttgttgga
10021 cggggagcac cggcgcctgg ccaggggccat cattgagctc acctatcgcc acaaagtagt
10081 gaaggtaatg cgcccggctg ctgatggaag aaccgtcatg gacgtcatct ccaggggaaga
10141 ccagagagga agtgggcaag ttgtcaccta cgctctaaac acctttacca acctggctgt
10201 ccaattggtg agaatgatgg aaggagaggg tgtgatcggc ccagatgatg tggagaaact
10261 cacaaagggg aaagggccca aggttagaac ctggctgtct gagaatgggg aggaaagact
10321 cagccgcatg gctgtcagtg gagatgactg tgtggtaaag cccttggatg atcgctttgc
10381 cacctctctc cactttctca acgccatgtc aaaggtgcgc aaggacatcc aagagtggaa
10441 accatcaacc ggatggtatg attggcagca agttccattc tgttcaaacc acttcactga
10501 actgatcatg aaagatggaa gaacactggt gactccatgc cgagggcagg atgagttagt
10561 gggcagagct cgcatctccc caggggctgg atggaatgtt cgagacactg cttgcttagc
10621 caaatcttat gctcagatgt ggttgctcct gtacttccac agaagagatc tgcggtttgat
10681 ggccaacgcc atctgctctg ccgtacctgt aaactgggtc cctactggaa gaaccacatg
10741 gtccatccac gctggaggag agtggatgac aacggaagac atgctggagg tctggaatcg
10801 tgtctggatt gaggaaaatg aatggatgga ggacaaaacc ccagtggaga agtggagtga
10861 tgttccatac tctggcaaac gagaggacat ttggtgtggc agcctgattg cacaagagc
10921 ccggccacg tgggcagaaa acattcaagt ggccatcaac caagtcagat caataattgg
10981 agatgagaaa tatgtggatt acatgagttc attgaagaga tatgaagaca caacattggt
11041 tgaggataca gtattgtaaa tactttgtta attgtaaata atatattgtta ttatgtgtag
11101 aagtttagct ttataatagt gtttagtgtg tttagagtta gaaaaatttt agtgaggaag
11161 tcaggccgga aaattcccgc caccggaagt tgagtagacg gtgctgcctg cgactcaacc
11221 ccaggaggac tgggtgaaca aagctgcgaa gtgatccatg taagccctca gaaccgtctc
11281 ggaaagagga ccccacatgt tgtagcttca aggcccaatg tcagaccacg ccatggcgtg
11341 ccactctgcg gagagtgcag tctgcgacag tgccccagga ggactgggtg aacaaaggcg
11401 aatcaacgtc ccacgcggcc ctagctctgg caatggtgtt aaccagagtg aaaggactag
11461 aggttagagg agaccccgcg ttctgaagtg cacggcccag cctggctgaa gctgtaggtc
11521 aggggaagga ctagaggtta gtgggagaccc cgtgccgcaa aacaccacaa caacacagca
11581 tattgacacc tgggatagac taggagatct tctgctctgc acaaccagcc acacggcaca
11641 gtgcgccgac aatggtggct ggtggtgcga gaacacagga tct
```

FIG. 36 cont.

>SEQ ID NO:28 WNV<sub>KUN</sub>/KRBV-prME chimeric ISF protein

```
MSKKPGGPGKSRAVNMLKRGMPRVLSLTGLKRAMLSLIDGRGPTRFVLALLAFFRFTAI
APTRAVLDRWRSVNKQTAMKHLLSFKKELGTLTSAINRRSSKQKKRGGKTGIAFMIGLI
AGVGAKTMNGIMDKGEHVWKADWNVDFTNVKLPKDFCGSGIHVEKMCPQVDSLQDA
TIDCAGRHDQFLLSYTRCAAKNRVKRGEPGVVEPKVTNIWTITFNDELNSIIERVSGMLK
NNRLMATAVICLVGAFKKWPTWLVVLLVLLPWTVVQASLADPFLILPKGDGLVKTRLY
PGQISSISTHVGVLDISYMAVDIEEGRLVERLMSHCEVNGTYSQDCCALGCNLDLSKLNE
RNRACQTATYNRGWATGCPVFGLGSVATCVEVACSDSVEVSELTSQNIRIPLSLRLQHE
ELNVTMTTEAPVTSKFSHHGVVSISCQIGNPGFLAQQYVLSNGKHKAMFPISAVSGWPGI
REIGGQYRNVDGSVKWGHVEANEIKVAAVYSDSIQWKTGIPIKTGIRDPLYLYCEVSLT
DLTFKKIRACESPVEVSFMAGPTGLDGXLEIGLLEQVNKTCSITGSCEGCTLPHPTSVISTS
DKKGHMHVECRTGTFTAIFGKQKFSFTCXXSYLRTIWATTAQAIGNYRKFGLDASGGPF
LDLWNKIGPNFSRLEVVGILVVAALLIDKRLLLLLAIFGYVTYVRADTGCAIDISRQELRC
GSGVFIHNDVEAWMDRYKYYPETPQGLAKIIQKAHKEGVCGLRSVSRLEHQMWEAVK
DELNTLLKENGVDLSIVVEKQEGMYKSAPRRLTATTEKLEIGWKAWGKSILFAPELANN
TFVIDGPETKECPTQNRAWNSLEVEDFGFGLTSTRMFLRVRESNTTECDSKIIGTAVKNN
LAIHSDLSYWIESRFNDTWKLERAVLGEVKSCTWPETHTLWGDGVLESDLIIPITLAGLR
SNHNRRPGYKTQSQGPWDEGRVEIDFDYCPGTTVTLSESCGHRGPATRTTTESGKLITD
WCCRSCTLPPLRYQTDNGCWYGMEIRPQRHDEKTLVQSQVNAYNADMIDPFQLGLLV
VFLATQEVLRKRWTAKISMPAILIALLVLVFGGITYTDVLRYVILVGAAFAESNSGGDVV
HLALMATFKIQPVFMVASFLKARWTNQENILLMLAAAFFQMAYYDARQILLWEMPDV
LNSLAVAWMILRAITFTTTSNVVVPLLALLTPGLRCLNLDVYRILLLMVGIGSLIREKRSA
AAKKKGASLLCLALASTGFFNPMILAAGLVACDPNRKRGWPATEVMTAVGLMFAIVG
GLAELDIDSMAIPMTIAGLMFAAFVISGKSTDMWIERTADISWEGDAEITGSSERVDVRL
DDDGNFQLMNDPGAPWKIWMLRMACLAISAYTPWAILPSVVGFWITLQYTKRGGVLW
DTPSPKEYKRGDTTTGVYRIMTRGLLGSYQAGAGVMVEGVFHTLWHTTKGAALMSGE
GRLDPYWGSVKEDRLCYGGPWKLQHKWNGQDEVQMIVVEPGKNVKNVQTKPGVFKT
PEGEIGAVTLDFPTGTSGSPIVDKNGDVIGLYGNGVIMPNGSYISAIVQGERMDEPVPAG
FEPEMLRKKQITVLDLHPGAGKTRRILPQIIKEAINRRLRTAVLAPTRVVAAEMAEALRG
LPIRYQTSAVAREHNGNEIVDVMCHATLTHRLMSPHRVPNYNLFVMDEAHFTDPASIAA
RGYISTRVELGEAAAIFMTATPPGTSDPFPESNAPISDLQTEIPDRAWNSGYEWITEYIGK
TVWFVPSVKMGNEIALCLQRAGKKVIQLNRKSYETEYPKCKNDDWDFVVTTDISEMGA
NFKASRVIDSRKSVKPTIITEGEGRVILGEPSAVTAASAAQRRGRIGRNPSQVGDEYCYG
GHTNEDDSNCAHWTEARIMLDNINMPNGLIAQFYQPEREKVYTMDGEYRLRGEERKNF
LELLRTADLPVWLAYKVAAAGVSYHDRRWCFDGPRTNTILEDNNEVEVITKLGERKILR
PRWIDARVYSDHQALKSFKDFASGKRSQIGFIEVLGKMPEHFMGKTWEALDTMYVVAT
AEKGGRAHRMALEELPDALQTIALIALLSVMTMGVFFLLMQRKGIGKIGLGGVVLGAA
TFFCWMAEVPGTKIAGMLLLSLLLMIVLIPEPEKQRSQTDNQLAVFLICVLTLVGAVAA
NEMGWLDKTKSDISGLFGQRIETKENFSIGEFLLDLRPATAWSLYAVTTAVLTPLLKHLI
TSDYINTSLTSINVQASALFTLARGFPFVDVGVSALLLAAGCWGQVTLTVTVTSATLLFC
HYAYMVPGWQAEAMRSAQRRTAAGIMKNAVVDGIVATDVPELERTTPIMQKKVGQV
MLILVSLAALVVNPSVKTVREAGILITAAAVTLWENGASSVWNATTAIGLCHIMRGGW
LSCLSITWTLVKNMEKPGLKRGGAKGRTLGEVWKERLNQMTKEEFIRYRKEAITEVDR
SAAKHARKERNITGGHPVSRGTAKLRWLVERRFLEPVGKVIDLGCGRGGWCYYMATQ
KRVQEVRGYTKGGPGHEEPQLVQSYGWNIVTMKSGVDVFYRPSECCDTLLCDIGESSSS
AEVEEHRTLRVLEMVEDWLHRGPKEFCVKVLCPYMPKVIEKMELLQRRYGGGLVRNP
LSRNSTHEMYWVSRASGNVVHSVNMTSQVLLGRMEKKTWKGPQYEEDVNLGSGTRA
VGKPLLNSDTSKIKNRIERLRREYSSTWHHDENHPYRTWNYHGSYEVKPTGSASSLVNG
VVRLLSKPWDTITNVTTMAMTDTTPFGQQRVFKEKVDTKAPEPPEGVKYVLNETTNWL
WAFLAREKRPRMCSREEFIRKVNSNAALGAMFEEQNQWRSAREAVEDPKFWEMVDEE
REAHLRGECHTCIYNMMGKREKKPGEFGKAKGSRAIWFMWLGARFLEFEALGFLNED
HWLGRKNSGGGVEGLGLQKLGYILREVGTRPGGRIYADDTAGWDTRITRADLENEAKV
LELLDGEHRRLARAIIELTYRHKVVKVMRPAADGRTVMDVISREDQRGSGQVVTYALN
TFTNLAVQLVRMMEGEGVIGPDDVEKLTKGKGPKVRTWLSENGEERLSRMAVSGDDC
VVKPLDDRFATSLHFLNAMSKVRKDIQEWKPSTGWYDWQQVPFCSNHFTELIMKDGRT
LVTPCRGQDELVGRARISPGAGWNVRDTACLAKSYAQMWLLLYFHRRDLRLMANAIC
SAVPVNWVPTGRTTWSIHAGGEWMTTEDMLEVWNRVWIEENEWMEDKTPVEKWSDV
PYSGKREDIWCGSLIGTRARATWAENIQVAINQVRSIIGDEKYVDYMSSLKRYEDTTLVE
DTVL
```

FIG. 37

SEQ ID NO:29    WNV_KUN/KRBV-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata tggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag cacctttata tcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtaggggg cccacacggt ttgtgttggc
1201 tctcttggcg tttttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcggag ctcaaaacag aagaagagag gaggaaagac
1381 cggaattgca ttcatgattg gcttgattgc tggcgtggga gcaaagacca tgaatggaat
1441 aatggacaag ggtgagcacg tttggaaagc tgactggaat gttgacttta ccaatgtgaa
1501 gctccccaag gacttctgcg gatctggaat acacgtggag aagatgtgtc ctcaggttga
1561 ttctttgcaa gatgcaacaa tcgactgcgc aggaagacat gaccaattc tcctgtccta
1621 tacacgatgt gcggctaaga atcgtgtcaa acgtggtgaa cccggagtag tggaaccgaa
1681 agtcacgaac atatggacca taacgttcaa tgatgagttg aacagcatca ttgaacgtgt
1741 gagcgggatg ctgaagaaca atcgattgat ggcaacagca gtcatttgct tagttggggc
1801 tttcaagaaa tggcctacat ggctcgtcgt gctttttggtt ttactgcctt ggactgtcgt
1861 gcaggcatca ctggccgatc ctttcttaat tctgccgaag ggtgatggtt tggtaaaaac
1921 tagattatac ccaggacaga tttcatcaat ttccacacac gttggggtac tggacatctc
1981 ttatatggct gtggacattg aggagggggcg actcgttgaa aggttgatgt cacattgcga
2041 agtaaatgga acttactcac aggattgttg cgctttggga tgcaacttgg acttatctaa
2101 gttaaatgag cggaacaggg cctgtcaaac ggctacctac aatcgcgggt gggctacggg
2161 atgtccagtt tttgactgg gcagtgtggc cacatgcgtt gaggtcgcgt gcagcgatag
2221 tgtggaggtg tccgaactga caagccagaa catccggatt cctctatctc tacgttttgca
2281 gcatgaagag ctgaatgtga ccatgacaac agaggcgcca gttacttcaa agttctcaca
2341 tcacgggtg gtatccatct cttgtcaaat tggcaatcct ggttcttgg cacagcagta
2401 cgtgctgagc aatgggaagc ataaagcaat gtttcccatc agtgcggtat caggttggcc
2461 tggaatccgt gagattggtg gacagtacag gaacgtggat ggctccgtca gtgggggca
2521 cgttgaagcg aatgagatta aggtggccgc tgtatatagt gacagcatcc aatggaagac
2581 tggaatcccg ataaagacag gtattagaga cccactgtat ttgtactgtg aagtgtcgct
2641 aactgacttg acttttcaaga aaataagagc atgtgaatcg cctgttgaag tttcgttcat
2701 ggcaggacct acggggttgg atggtcgrct agaaattggg ttgcttgagc aagtcaacaa
2761 aacatgctca ataacaggga gctgtgaagg ttgtaccttta ccgcacccaa ccagtgtcat
2821 ttcgacttct gacaagaaag gccacatgca cgtagaatgt cgcacgggga catttacggc
2881 aaatattcgga aagcaaaaat tttcttttcac ctgtcrracw agttacctca gaactatttg
2941 ggctacgact gcccaggcga ttggaaatta taggaaattc ggactggatg cctcaggagg
```

FIG. 38

```
3001 accattttg gacttatgga ataagatagg tccaaatttc tcccgtttgg aggttgttgg
3061 aatccttgtt gtggcagcct tgttaattga caaaagactc ttacttctcc tggctatttt
3121 tggatacgtc acatacgtgc gagctgatac tggatgtgcc atagatataa gtcggcaaga
3181 gttgaggtgt ggcagcggag tatttataca caatgatgtg gaagcttgga tggaccgata
3241 caagtactac cctgaaacac cacaaggtct agctaagatc attcaaaagg ctcacaagga
3301 aggagtgtgc ggtctacgat cagtttctag attggaacac caaatgtggg aagcagtgaa
3361 ggatgaacta aacactcttt tgaaggaaaa tggtgtggac cttagtattg tggttgagaa
3421 acaggagggg atgtacaaat cagcacctag acgcctgact gccaccactg agaaactgga
3481 aataggctgg aaagcctggg ggaagagcat tctgttcgca ccagaactgg ccaacaacac
3541 ttttgtgatt gatggtccgg agaccaagga gtgtccaacc cagaaccgtg cctggaacag
3601 cttggaggtg gaagattttg gattcggcct caccagcact cggatgttct tgagggtcag
3661 agaaagcaac acgactgaat gtgactcaaa gatcatcggg acagccgtca agaataactt
3721 ggcgatccat agcgatctat cctactggat tgaaagcagg tttaatgaca cgtggaagct
3781 cgaaagggcg gtcctaggtg aagtcaaatc atgcacgtgg ccggaaacac ataccctgtg
3841 gggtgacggg gtccttgaga gtgacctaat aataccaatc acgctagcgg gactgcgaag
3901 caaccacaac cggaggcctg ggtataaaac acaaagccag ggtccatggg atgaaggtcg
3961 agtggagatt gactttgatt actgtccagg gacaacggtc actctgagtg agagctgcgg
4021 gcatcgtgga cctgccaccc gcaccactac agagagtgga aagctgataa cggactggtg
4081 ctgtaggagc tgcaccttac ctccattgcg ctaccagaca gacaatggtt gttggtatgg
4141 catggagatt aggccacaga gacatgatga aaaaactctt gtgcagtcac aggtgaatgc
4201 ctacaacgct gacatgattg atcctttca gctgggcctt ctggtcgtgt tcttggccac
4261 ccaggaggtc cttcgcaaga ggtggacagc caagatcagc atgccagcca tactgattgc
4321 cctgctagtt ctagtgtttg ggggcatcac ttacactgat gtgttacgct atgtcattct
4381 ggtgggggcg gcctttgcag aatccaactc aggaggagat gtggtgcatc tggcgctcat
4441 ggcaaccttc aagatacaac cagtgttcat ggtagcatca tttctcaagg cgagatggac
4501 caaccaagaa aacattctgc tgatgttggc agctgctttc ttccaaatgg cttactatga
4561 tgccccggca attttgcttt gggaaatgcc tgatgtattg aattcattgg cagtggcttg
4621 gatgatattg agagcgataa cgttcaccac aacatctaat gtggtcgtcc cgctgctggc
4681 cttgttaaca cctgattga gatgcctaaa cctggatgtg tacaggatcc tgctactgat
4741 ggttggaata ggcagtttga tcagggaaaa aagaagtgca gctgcaaaaa agaaaggagc
4801 cagtctgcta tgtttggctc tagcctcaac aggatttttt aaccccatga tccttgctgc
4861 tggacttgtc gcatgtgatc ccaatcgcaa gcgggggtgg cctgcaactg aagtgatgac
4921 agctgtcggc ttaatgtttt ccatcgttgg agggcttgca gaactggaca tagactccat
4981 ggccattcca atgactatcg cagggctcat gtttgctgct tttgtgatct ctggaaaatc
5041 gaccgacatg tggattgaga ggacagcgga catctcctgg gagggtgatg cggaaatcac
5101 aggttccagt gaaagagttg atgttcggct tgacgatgac gggaacttcc agctcatgaa
5161 tgatccagga gcaccttgga aaatatggat gctccgtatg gcttgcctgg caatcagcgc
5221 gtacacccct tgggctattt gccttcagt agttggattt tggataactc tccaatacac
5281 aaagagagga ggtgtgctgt gggacactcc ctctccaaag gagtacaaga gaggggacac
5341 gaccactggt gtctatagga tcatgactcg tggattactt ggtagttacc aagcaggagc
5401 aggcgtgatg gttgaaggtg ttttccacac cctctggcac acgacaaag gagccgctct
5461 gatgagcgga gaaggccgcc tggatccata ttgggcagc gtcaaggagg atcgactttg
5521 ttatggtgga ccctggaaac tgcagcacaa gtggaatggg caagatgagg tgcaaatgat
5581 tgtggtggaa ccagggaaga atgtcaagaa cgtccagact aagccggggg tgttcaaaac
5641 acctgaaggg gagatcgggg ccgtgactct ggattcccc actgaacat caggctcgcc
5701 catagtggac aaaaacggtg atgtgattgg gctttatggc aacggagtca taatgcccaa
5761 tggctcatac ataagcgcga tagtgcaagg tgaaaggatg gatgagccgg ttcccgccgg
5821 attcgaacct gagatgttga ggaaaaaaca gatcaccgtt ttggatcttc accctggtgc
5881 tggtaaaaca aggaggattc tgccacagat catcaaagag gctataaaca ggaggctgag
5941 gacggctgtg ctggcgccaa ctaggggttgt ggccgctgag atggctgaag ccctaagagg
6001 attgcctatc cgataccaaa catctgcggt ggccagagag cacaatggaa atgagatcgt
```

FIG. 38 cont.

6061 cgacgtcatg tgccatgcaa ccctcaccca taggctgatg tctcctcata gggtgcctaa
6121 ttacaaccta tttgtgatgg acgaggccca cttcaccgac ccagccagca tcgcggctag
6181 aggatacatt tccacgagag ttgagctggg ggaggcagct gcaatattca tgactgccac
6241 cccaccaggt acctcagacc catttccaga gtccaatgca ccaatatccg acttacagac
6301 cgaaatcccg gaccgagcct ggaactcagg gtatgagtgg attacagaat atatcgggaa
6361 gacggtttgg tttgtgccta gtgtgaagat gggaaatgag atagccctct gtctgcagcg
6421 cgctggcaaa aaagtcatcc agctaaacag aaagtcgtac gagacagagt atccaaaatg
6481 caagaacgat gattgggact ttgtcgtcac aacagatata tctgagatgg gagcaaactt
6541 taaggcaagc agggtgattg acagccggaa gagtgtgaaa ccgactatca tcacggaagg
6601 agagggaaga gtgatcttgg gggaaccatc cgctgtgacg gcagccagtg cagcccagag
6661 acgaggacgc attggtagga atccatcaca agttggagat gagtactgct atggagggca
6721 cacgaatgag gatgactcga actgtgctca ctggactgag gcacgaatca tgctcgataa
6781 catcaacatg ccaaacggat tgattgctca attctaccaa ccagagcgcg agaaggtata
6841 caccatggac ggggaatacc gacttagagg agaggagagg aaaaacttcc tggaattgtt
6901 gagaactgca gacttgccag tatggctagc ttataaggtg gcagcagctg gggtgtcata
6961 tcatgaccgg aggtggtgtt ttgatggccc taggacaaat acaatccttg aagacaacaa
7021 tgaagtggaa gtcatcacaa agcttggtga aaggaagatt ctgaggccac gctggattga
7081 tgcaagggtg tactcagacc atcaggcgct gaaatcattc aaggacttcg cctcagggaa
7141 gcgctctcaa ataggttta tcgaggtcct tggaaagatg cctgaacatt tcatggggaa
7201 gacatgggaa gcactcgaca ccatgtatgt tgtagccact gcagagaaag gaggaagagc
7261 tcacagaatg gctttggagg agctaccaga cgccctccaa acaatagctc tgatcgctct
7321 gttgagtgtg atgaccatgg gagtgttttt tcttctcatg cagaggaagg gcatcggaaa
7381 gataggcctg ggaggcgttg tcctgggagc cgcaaccttt ttctgttgga tggctgaagt
7441 accaggaacg aagattgccg gaatgctgct gctttccctc ttctgatga tcgtgttgat
7501 tcctgagcca gagaagcaac gctcgcagac agacaaccag ctagctgtgt tcctgatttg
7561 cgtgttgacc cttgtgggtg cggtggcagc caatgagatg ggttggctgg acaagaccaa
7621 gagtgacata agcggtctgt ttgggcaaag aattgaaacc aaggagaatt ttagcattgg
7681 ggagttcctt ttggacctga ggccggcaac ggcttggtca ctgtatgctg tgactacagc
7741 agttctcact cccttgctaa agcacttgat cacgtcagac tacatcaaca cctcattgac
7801 ctcaataaat gttcaagcta gtgcgctatt cacgctcgcg cgaggcttcc cttttgtcga
7861 tgttggagta tcggctctcc tgctagcagc cggatgctgg ggacaagtca ctctcaccgt
7921 gacggtgaca tcagcaacac ttctgttctg ccattatgcc tacatggtac ctggatggca
7981 ggctgaggca atgcgctcag cccagcgacg aacagccgct ggaatcatga aaaacgctgt
8041 ggtagacggc atcgtggcca cggacgttcc agagctagag cgtaccacac ccatcatgca
8101 gaagaaggtt ggacaagtta tgctgatttt ggtgtctctt gccgcattgg tggtaaaccc
8161 gtctgtgaag acagtgcggg aagccggaat tctgattacg gcagcagctg ttacccctctg
8221 ggagaacgga gcaagctctg tgtggaacgc aacaaccgcc ataggacttt gtcacatcat
8281 gcgcggaggc tggttatcgt gtttatccat aacatggact cttgtaaaaa acatggaaaa
8341 accagggctg aagagaggtg gggcaaaagg acgcaccttg ggggagggtttt ggaaagaaag
8401 acttaaccag atgacgaaag aagaattcat caggtaccgt aaagaagcca tcactgaagt
8461 tgaccgctca gcagcaaaac acgctaggaa ggaaaggaat atcactggag gcatccagt
8521 ttctagaggc acggcaaagc taagatggct ggtcgagagg aggtttcttg aaccggtcgg
8581 aaaagtgatc gaccttggat gtgaagagg cggctggtgt tattacatgg ccacacaaaa
8641 aagagtccaa gaagtcagag ggtacacaaa aggtggtccc ggacatgaag agccccagct
8701 agtgcagagc tatggatgga acattgtcac catgaagagt gggggtggatg tgttctatag
8761 gccttctgaa tgttgtgaca ctctcctttg tgatatcgga gagtcctcat caagtgctga
8821 agttgaagaa catagaacgc tacgagtcct tgaaatggtg gaagactggt tgcatcgagg
8881 gccaaaggaa ttttgtgtga aggtactgtg cccctacatg ccaaaggtca tagaaaagat
8941 ggagctgctc aacgccggt atggcggggg attggttagg aacccactct cacggaattc
9001 cacacatgaa atgtattggg tgagtcgagc ctcaggcaat gtggtgcact cagtgaacat
9061 gaccagccag gtactcttag gaaggatgga gaagaagacc tggaagggac ctcagtacga

FIG. 38 cont.

```
 9121 agaagacgtg aacttgggaa gcggaacgag agcagtggga aaacctctac tcaactcaga
 9181 caccagcaag ataaagaaca ggattgaacg acttaggcgt gagtacagct cgacatggca
 9241 tcatgatgag aaccacccat atagaacctg gaactaccac ggtagctacg aagtgaagcc
 9301 aacaggctct gcaagctcac tggtcaatgg agtggtcagg ctcctctcga aaccatggga
 9361 caccatcaca aatgtcacca caatggccat gacgacacc accccttttg dacaacagcg
 9421 agtgttcaaa gagaaggtgg acacgaaagc tccggaaccg ccagaaggag tgaagtatgt
 9481 gctcaatgaa accaccaact ggttgtgggc gttcctggca cgagaaaagc gtcccagaat
 9541 gtgctcgcga gaggaattta taaggaaggt caatagtaat gcagctctgg gcgccatgtt
 9601 tgaggagcag aatcaatgga ggagtgctag agaagcggtt gaagatccaa aattctggga
 9661 aatggtggat gaagagcgtg aggcgcactt acgcggagaa tgtcatactt gcatttacaa
 9721 catgatggga aagagggaga aaaaacccgg agagtttggg aaagccaagg gaagcagggc
 9781 catctggttt atgtggctgg gagctcgctt cctagagttt gaggctctgg gctttcttaa
 9841 tgaggaccac tggcttggaa gaaagaactc gggggggcggg gtcgagggtc tgggcctcca
 9901 gaaattaggc tacatcctgc gtgaagttgg cacccgaccc ggaggcagaa tctacgctga
 9961 tgacacagcc ggttgggaca cccgcatcac aagagctgac ctggagaatg aagccaaggt
10021 tcttgagttg ttggacgggg agcaccggcg cctggccagg gccatcattg agctcaccta
10081 tcgccacaaa gtagtgaagg taatgcgccc ggctgctgat ggaagaaccg tcatggacgt
10141 catctccagg gaagaccaga gaggaagtgg gcaagttgtc acctacgctc taaacacctt
10201 taccaacctg gctgtccaat tggtgagaat gatggaagga gagggtgtga tcggcccaga
10261 tgatgtggag aaactcacaa aggggaaagg gcccaaggtt agaacctggc tgtctgagaa
10321 tgggaggaa agactcagcc gcatggctgt cagtggagat gactgtgtgg taaagcccct
10381 ggatgatcgc tttgccacct ctctccactt tctcaacgcc atgtcaaagg tgcgcaagga
10441 catccaagag tggaaaccat caaccggatg gtatgattgg cagcaagttc cattctgttc
10501 aaaccacttc actgaactga tcatgaaaga tggaagaaca ctggtgactc catgccgagg
10561 gcaggatgag ttagtgggca gagctcgcat ctccccaggg gctggatgga atgttcgaga
10621 cactgcttgc ttagccaaat cttatgctca gatgtggttg ctcctgtact tccacagaag
10681 agatctgcgg ttgatggcca acgccatctg ctctgccgta cctgtaaact gggtccctac
10741 tggaagaacc acatggtcca tccacgctgg aggagagtgg atgacaacgg aagacatgct
10801 ggaggtctgg aatcgtgtct ggattgagga aaatgaatgg atggaggaca aaacccagt
10861 ggagaagtgg agtgatgttc atactctgg caaacgagag acatttggt gtggcagcct
10921 gattggcaca agagcccggg ccacgtgggc agaaaacatt caagtggcca tcaaccaagt
10981 cagatcaata attggagatg agaaatatgt ggattacatg agttcattga agagatatga
11041 agacacaaca ttggttgagg atacagtatt gtaaatactt tgttaattgt aaataaatat
11101 tgttattatg tgtagaagtt tagctttata atagtgttta gtgtgtttag agttagaaaa
11161 attttagtga ggaagtcagg ccgaaaatt cccgccaccg gaagttgagt agacggtgct
11221 gcctgcgact caaccccagg aggactgggt gaacaaagct gcgaagtgat ccatgtaagc
11281 cctcagaacc gtctcggaaa gaggaccca catgttgtag cttcaaggcc caatgtcaga
11341 ccacgccatg gcgtgccact ctgcggagag tgcagtctgc gacagtgccc caggaggact
11401 gggtgaacaa aggcgaatca acgtcccacg cggccctagc tctggcaatg gtgttaacca
11461 gagtgaaagg actagaggtt agaggagacc ccgcgttctg aagtgcacgg cccagcctgg
11521 ctgaagctgt aggtcagggg aaggactaga ggttagtgga daccccgtgc cgcaaaacac
11581 cacaacaaca cagcatattg acactggga tagactagga gatcttctgc tctgcacaac
11641 cagccacacg gcacagtgcg ccgacaatgg tggctggtgg tgcgagaaca caggatct
```

FIG. 38 cont.

>SEQ ID NO:30  WNV<sub>KUN</sub>/PaRV-prME chimeric ISF protein

MSKKPGGPGKSRAVNMLKRGMPRVLSLTGLKRAMLSLIDGRGPTRFVLALLAFFRFT
AIAPTRAVLDRWRSVNKQTAMKHLLSFKKELGTLTSAINRRSSKQKKRGGKTGIAFMI
GLIAGVGAVTIQVVVTTDARIELWSDRKNFTAHAHLVKVPTDVCNDGVFVTKHCPKV
EKLSDLGEIDCGSSWSEFTLTYTRCVTLERASRAEEKGKTMLGQFKEDLSTLETEAFLL
FKKHAFSTILVLLVLAIVMKWPVWVVVILGILAWNVVKGEFVEPFLVLKHDHSTMLM
TRLYPGEIAHVATPAGLVDIRVSHAQIFGGQRFRELLSDCSVNASYSTDICPGGSQLDL
ESIKGPGRVCMTAPYNRGWGTGCFKWGIGAVATCVELNCTRETKVDLLTNSAIVANV
TVNFHSTNDTKLLVPDTPITLKFGKLGTMTMTCRLGNDRIANDFYHVTDNIASGLFQK
ALIDAWEGPSKMANHISGHEKVVKWGHILPNEIKVSKIIEMELDWEKAITTHDGFSNT
YFWCQVAVNKLVVGSFASCKSGAKASFIQSSWGFDGVVEVTLDEATKTICSLPLTCT
GCSLLATKVVFLEGSQRAVGHVGCGNGTSMLTVGTTKVGIQCVVTPVSQIWNFVTHA
SGRYAKLGFGGVGGAFHDLLVKVGLTFTWDSWKIITVLSGLVVAFAIFDRKLVILIIIL
CGIAYTRADTGCAIDISRQELRCGSGVFIHNDVEAWMDRYKYYPETPQGLAKIIQKAH
KEGVCGLRSVSRLEHQMWEAVKDELNTLLKENGVDLSIVVEKQEGMYKSAPRRLTA
TTEKLEIGWKAWGKSILFAPELANNTFVIDGPETKECPTQNRAWNSLEVEDFGFGLTS
TRMFLRVRESNTTECDSKIIGTAVKNNLAIHSDLSYWIESRFNDTWKLERAVLGEVKS
CTWPETHTLWGDGVLESDLIIPITLAGLRSNHNRRPGYKTQSQGPWDEGRVEIDFDYC
PGTTVTLSESCGHRGPATRTTTESGKLITDWCCRSCTLPPLRYQTDNGCWYGMEIRPQ
RHDEKTLVQSQVNAYNADMIDPFQLGLLVVFLATQEVLRKRWTAKISMPAILIALLVL
VFGGITYTDVLRYVILVGAAFAESNSGGDVVHLALMATFKIQPVFMVASFLKARWTN
QENILLMLAAAFFQMAYYDARQILLWEMPDVLNSLAVAWMILRAITFTTTSNVVVPL
LALLTPGLRCLNLDVYRILLLMVGIGSLIREKRSAAAKKKGASLLCLALASTGFFNPMI
LAAGLVACDPNRKRGWPATEVMTAVGLMFAIVGGLAELDIDSMAIPMTIAGLMFAA
FVISGKSTDMWIERTADISWEGDAEITGSSERVDVRLDDDGNFQLMNDPGAPWKIWM
LRMACLAISAYTPWAILPSVVGFWITLQYTKRGGVLWDTPSPKEYKRGDTTTGVYRI
MTRGLLGSYQAGAGVMVEGVFHTLWHTTKGAALMSGEGRLDPYWGSVKEDRLCY
GGPWKLQHKWNGQDEVQMIVVEPGKNVKNVQTKPGVFKTPEGEIGAVTLDFPTGTS
GSPIVDKNGDVIGLYGNGVIMPNGSYISAIVQGERMDEPVPAGFEPEMLRKKQITVLD
LHPGAGKTRRILPQIIKEAINRRLRTAVLAPTRVVAAEMAEALRGLPIRYQTSAVAREH
NGNEIVDVMCHATLTHRLMSPHRVPNYNLFVMDEAHFTDPASIAARGYISTRVELGE
AAAIFMTATPPGTSDPFPESNAPISDLQTEIPDRAWNSGYEWITEYIGKTVWFVPSVKM
GNEIALCLQRAGKKVIQLNRKSYETEYPKCKNDDWDFVVTTDISEMGANFKASRVID
SRKSVKPTIITEGEGRVILGEPSAVTAASAAQRRGRIGRNPSQVGDEYCYGGHTNEDDS
NCAHWTEARIMLDNINMPNGLIAQFYQPEREKVYTMDGEYRLRGEERKNFLELLRTA
DLPVWLAYKVAAAGVSYHDRRWCFDGPRTNTILEDNNEVEVITKLGERKILRPRWID
ARVYSDHQALKSFKDFASGKRSQIGFIEVLGKMPEHFMGKTWEALDTMYVVATAEK
GGRAHRMALEELPDALQTIALIALLSVMTMGVFFLLMQRKGIGKIGLGGVVLGAATF
FCWMAEVPGTKIAGMLLLSLLLMIVLIPEPEKQRSQTDNQLAVFLICVLTLVGAVAAN
EMGWLDKTKSDISGLFGQRIETKENFSIGEFLLDLRPATAWSLYAVTTAVLTPLLKHLI
TSDYINTSLTSINVQASALFTLARGFPFVDVGVSALLLAAGCWGQVTLTVTVTSATLL
FCHYAYMVPGWQAEAMRSAQRRTAAGIMKNAVVDGIVATDVPELERTTPIMQKKV
GQVMLILVSLAALVVNPSVKTVREAGILITAAAVTLWENGASSVWNATTAIGLCHIM
RGGWLSCLSITWTLVKNMEKPGLKRGGAKGRTLGEVWKERLNQMTKEEFIRYRKEA
ITEVDRSAAKHARKERNITGGHPVSRGTAKLRWLVERRFLEPVGKVIDLGCGRGGWC
YYMATQKRVQEVRGYTKGGPGHEEPQLVQSYGWNIVTMKSGVDVFYRPSECCDTLL
CDIGESSSSAEVEEHRTLRVLEMVEDWLHRGPKEFCVKVLCPYMPKVIEKMELLQRR
YGGGLVRNPLSRNSTHEMYWVSRASGNVVHSVNMTSQVLLGRMEKKTWKGPQYEE
DVNLGSGTRAVGKPLLNSDTSKIKNRIERLRREYSSTWHHDENHPYRTWNYHGSYEV
KPTGSASSLVNGVVRLLSKPWDTITNVTTMAMTDTTPFGQQRVFKEKVDTKAPEPPE
GVKYVLNETTNWLWAFLAREKRPRMCSREEFIRKVNSNAALGAMFEEQNQWRSARE
AVEDPKFWEMVDEEREAHLRGECHTCIYNMMGKREKKPGEFGKAKGSRAIWFMWL
GARFLEFEALGFLNEDHWLGRKNSGGGVEGLGLQKLGYILREVGTRPGGRIYADDTA
GWDTRITRADLENEAKVLELLDGEHRRLARAIIELTYRHKVVKVMRPAADGRTVMD
VISREDQRGSGQVVTYALNTFTNLAVQLVRMMEGEGVIGPDDVEKLTKGKGPKVRT
WLSENGEERLSRMAVSGDDCVVKPLDDRFATSLHFLNAMSKVRKDIQEWKPSTGWY
DWQQVPFCSNHFTELIMKDGRTLVTPCRGQDELVGRARISPGAGWNVRDTACLAKS
YAQMWLLLYFHRRDLRLMANAICSAVPVNWVPTGRTTWSIHAGGEWMTTEDMLEV
WNRVWIEENEWMEDKTPVEKWSDVPYSGKREDIWCGSLIGTRARATWAENIQVAIN
QVRSIIGDEKYVDYMSSLKRYEDTTLVEDTVL

FIG. 39

SEQ ID NO:31   WNV$_{KUN}$/PaRV-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag cacctttata ctcggtggcc tccccaccac
 541 caacttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtaggggg cccacacggt ttgtgttggc
1201 tctcttggcg ttttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcggag ctcaaaacag aagaagagag gaggaaagac
1381 cggaattgca ttcatgattg gcttgattgc tggcgtggga gcagtgacaa tccaagtggt
1441 tgtcactact gatgcacgaa tcgagctttg gtctgaccgg aagaacttta cagctcacgc
1501 tcacctcgtc aaggttccta ccgacgtttg caatgatggg gtgtttgtaa caaaacattg
1561 tcccaaagtt gagaagttga gtgaccttgg cgaaatcgat tgcggttcat catggtctga
1621 atttaccttg acttacacac gatgcgtaac cttggaaaga gcctcacgtg cggaagagaa
1681 gggaaagaca atgctggggc agttcaagga ggatctttcc accctggaaa ctgaggcttt
1741 tttgctgttt aaaaaacatg cgttctcgac catcctggtt ttgctagtat tggccatcgt
1801 tatgaagtgg cccgtgtggg ttgtggtaat actggggatt ctagcgtgga acgtcgtgaa
1861 aggtgagttt gttgagccat tcttggtttt aaaacatgac cacagtacta tgctcatgac
1921 cagactgtac ccaggagaaa tcgctcacgt tgcaactcct gccgggttgg tggacattcg
1981 tgttagccat gcccaaattt tggaggtca acgctttcgt gagttactga gcgactgctc
2041 tgtgaacgct tcgtattcga ccgacatatg ccccggagga tcacaacttg acttggaatc
2101 gatcaaaggt cctggacgtg tctgcatgac cgctccgtac aatcgaggat ggggaaccgg
2161 atgtttcaaa tggggaattg gagctgttgc cacgtgcgtt gagttgaact gcacacggga
2221 aacaaaagtt gatttgttga caaattctgc tattgtggcc aacgtgacag tcaatttcca
2281 ctcgaccaat gacactaaac tccttgtgcc tgacacccca attacgttga gtttgggaa
2341 gttaggaacg atgacaatga cgtgtcgttt gggaaatgac cgcattgcta acgattttta
2401 ccatgtaact gacaatattg catctggact gttccagaaa gctttgattg atgcgtggga
2461 aggaccctcc aagatggcga accacattag cggacatgaa aaagtcgtga agtggggtca
2521 cattctccca aatgagatca aggtcagcaa gatcattgaa atggagttag attgggaaa
2581 ggcgatcacc acacatgatg gattttcgaa cacctatttt tggtgtcaag tggccgtgaa
2641 caagttggtc gttgggtcat tgcctcatg caagagcgga gcgaaggcta gcttcatcca
2701 atcctcgtgg ggttttgatg gtgtggttga agtgactttg gatgaggcca ccaaaaccat
2761 ttgctcccta cccctgacat gtaccggatg tagcttgttg gctacaaaag tggttttcct
2821 tgagggaagc cagcgggctg ttgggcacgt ggggtgtgga aatgaacat caatgttgac
2881 agtaggaacg acaaaggttg ggatccaatg tgtggtcaca ccggtgtcac aaatttggaa
2941 cttcgtgact cacgcttccg gacgatatgc gaaacttggt tttggaggag ttggaggagc
```

FIG. 40

3001 tttccatgat ctgctagtga aggttggatt gaccttcacc tgggattcat ggaagatcat
3061 caccgtgttg tctggtctcg tagtggcttt tgccatcttt gatcggaagt tggtgatcct
3121 gatcattatc ctctgtggaa tcgcttatac ccgagctgat actggatgtg ccatagatat
3181 aagtcggcaa gagttgaggt gtggcagcgg agtatttata cacaatgatg tggaagcttg
3241 gatggaccga tacaagtact accctgaaac accacaaggt ctagctaaga tcattcaaaa
3301 ggctcacaag gaaggagtgt gcggtctacg atcagtttct agattggaac accaaatgtg
3361 ggaagcagtg aaggatgaac taaacactct tttgaaggaa aatggtgtgg accttagtat
3421 tgtggttgag aaacaggagg ggatgtacaa atcagcacct agacgcctga ctgccaccac
3481 tgagaaactg gaaataggct ggaaagcctg ggggaagagc attctgttcg caccagaact
3541 ggccaacaac acttttgtga ttgatggtcc ggagaccaag gagtgtccaa cccagaaccg
3601 tgcctggaac agcttggagg tggaagattt tggattcggc ctcaccagca ctcggatgtt
3661 cttgagggtc agagaaagca acacgactga atgtgactca aagatcatcg ggacagccgt
3721 caagaataac ttggcgatcc atagcgatct atcctactgg attgaaagca ggtttaatga
3781 cacgtggaag ctcgaaaggg cggtcctagg tgaagtcaaa tcatgcacgt ggccggaaac
3841 acatccctg tggggtgacg gggtccttga gagtgaccta ataataccaa tcacgctagc
3901 gggactgcga agcaaccaca accggaggcc tgggtataaa acacaaagcc agggtccatg
3961 ggatgaaggt cgagtggaga ttgactttga ttactgtcca gggacaacgg tcactctgag
4021 tgagagctgc gggcatcgtg gacctgccac ccgcaccact acagagagtg gaaagctgat
4081 aacggactgg tgctgtagga gctgcacctt acctccattg cgctaccaga cagacaatgg
4141 ttgttggtat ggcatggaga ttaggccaca gagacatgat gaaaaaactc ttgtgcagtc
4201 acaggtgaat gcctacaacg ctgacatgat tgatccttt cagctgggcc ttctggtcgt
4261 gttcttggcc acccaggagg tccttcgcaa gaggtggaca gccaagatca gcatgccagc
4321 catactgatt gccctgctag ttctagtgtt tgggggcatc acttacactg atgtgttacg
4381 ctatgtcatt ctggtgggg cggcctttgc agaatccaac tcaggaggag atgtggtgca
4441 tctggcgctc atggcaacct tcaagataca accagtgttc atggtagcat catttctcaa
4501 ggcgagatgg accaaccaag aaaacattct gctgatgttg gcagctgctt tcttccaaat
4561 ggcttactat gatgcccggc aaattttgct ttgggaaatg cctgatgtat tgaattcatt
4621 ggcagtggct tggatgatat tgagagcgat aacgttcacc acaacatcta atgtggtcgt
4681 cccgctgctg gccttgttaa cacctggatt gagatgccta aacctgatg tgtacaggat
4741 cctgctactg atggttggaa taggcagttt gatcagggaa aaaagaagtg cagctgcaaa
4801 aaagaaagga gccagtctgc tatgtttggc tctagcctca acaggatttt taacccccat
4861 gatccttgct gctggacttg tcgcatgtga tccccatcgc aagcgggggt ggcctgcaac
4921 tgaagtgatg acagctgtcg gcttaatgtt tgccatcgtt ggagggcttg cagaactgga
4981 catagactcc atggccattc aatgactact cgcagggctc atgtttgctg cttttgtgat
5041 ctctggaaaa tcgaccgaca tgtggattga gaggacagcg gacatctcct ggagggtga
5101 tgcggaaatc acaggttcca gtgaaagagt tgatgttcgg cttgacgatg acgggaactt
5161 ccagctcatg aatgatccag gagcaccttg gaaaatatgg atgctccgta tggcttgcct
5221 ggcaatcagc gcgtacaccc cttgggctat tttgccttca gtagttggat tttggataac
5281 tctccaatac acaaagagag gaggtgtgct gtgggacact ccctctccaa aggagtacaa
5341 gagaggggac acgaccactg gtgtctatag gatcatgact cgtggattac ttggtagtta
5401 ccaagcagga gcaggcgtga tggttgaagg tgttttccac accctctggc acacgacaaa
5461 aggagccgct ctgatgagcg gagaaggccg cctggatcca tattgggca gcgtcaagga
5521 ggatcgactt tgttatggtg gaccctggaa actgcagcac aagtggaatg gcaagatga
5581 ggtgcaaatg attgtggtgg aaccagggaa gaatgtcaag aacgtccaga ctaagccggg
5641 ggtgttcaaa acacctgaag gggagatcgg ggccgtgact ctggatttcc ccactggaac
5701 atcaggctcg cccatagtgg acaaaaacgg tgatgtgatt gggctttatg gcaacggagt
5761 cataatgccc aatggctcat acataagcgc gatagtgcaa ggtgaaagga tggatgagcc
5821 ggttccccgcc ggattcgaac ctgagatgtt gaggaaaaaa cagatcaccg tttggatct
5881 tcaccctggt gctggtaaaa caaggaggat tctgccacag atcatcaaag aggctataaa
5941 caggaggctg aggacggctg tgctggcgcc aactaggggtt gtggccgctg agatggctga
6001 agccctaaga ggattgccta tccgatacca aacatctgcg gtggccagag agcacaatgg

FIG. 40 cont.

6061 aaatgagatc gtcgacgtca tgtgccatgc aaccctcacc cataggctga tgtctcctca
6121 tagggtgcct aattacaacc tatttgtgat ggacgaggcc cacttcaccg acccagccag
6181 catcgcggct agaggataca tttccacgag agttgagctg ggggaggcag ctgcaatatt
6241 catgactgcc accccaccag gtacctcaga cccatttcca gagtccaatg caccaatatc
6301 cgacttacag accgaaatcc cggaccgagc ctggaactca gggtatgagt ggattacaga
6361 atatatcggg aagacggttt ggttgtgcc tagtgtgaag atgggaaatg agatagccct
6421 ctgtctgcag cgcgctggca aaaagtcat ccagctaaac agaaagtcgt acgagacaga
6481 gtatccaaaa tgcaagaacg atgattggga ctttgtcgtc acaacagata tatctgagat
6541 gggagcaaac tttaaggcaa gcagggtgat tgacagccgg aagagtgtga aaccgactat
6601 catcacggaa ggagagggaa gagtgatctt gggggaacca tccgctgtga cggcagccag
6661 tgcagcccag agacgaggac gcattggtag gaatccatca caagttggag atgagtactg
6721 ctatggaggg cacacgaatg aggatgactc gaactgtgct cactggactg aggcacgaat
6781 catgctcgat aacatcaaca tgccaaacgg attgattgct caattctacc aaccagagcg
6841 cgagaaggta tacaccatgg acggggaata ccgacttaga ggagaggaga ggaaaaactt
6901 cctggaattg ttgagaactg cagacttgcc agtatggcta gcttataagg tggcagcagc
6961 tggggtgtca tatcatgacc ggaggtggtg ttttgatggc cctaggacaa atacaatcct
7021 tgaagacaac aatgaagtgg aagtcatcac aaagcttggt gaaaggaaga ttctgaggcc
7081 acgctggatt gatgcaaggg tgtactcaga ccatcaggcg ctgaaatcat tcaaggactt
7141 cgcctcaggg aagcgctctc aaataggttt tatcgaggtc cttggaaaga tgcctgaaca
7201 tttcatgggg aagacatggg aagcactcga caccatgtat gttgtagcca ctgcagagaa
7261 aggaggaaga gctcacagaa tggctttgga ggagctacca gacgccctcc aaacaatagc
7321 tctgatcgct ctgttgagtg tgatgaccat gggagtgttt tttcttctca tgcagaggaa
7381 gggcatcgga aagataggcc tgggaggcgt tgtcctggga gccgcaacct ttttctgttg
7441 gatggctgaa gtaccaggaa cgaagattgc cggaatgctg ctgctttccc tccttctgat
7501 gatcgtgttg attcctgagc cagagaagca acgctcgcag acagacaacc agctagctgt
7561 gttcctgatt tgcgtgttga cccttgtggg tgcggtggca gccaatgaga tgggttggct
7621 ggacaagacc aagagtgaca taagcggtct gtttgggcaa agaattgaaa ccaaggagaa
7681 ttttagcatt ggggagttcc ttttggacct gaggccggca acggcttggt cactgtatgc
7741 tgtgactaca gcagttctca ctcccttgct aaagcacttg atcacgtcag actacatcaa
7801 cacctcattg acctcaataa atgttcaagc tagtgcgcta ttcacgctcg cgcgaggctt
7861 ccctttttgtc gatgttggag tatcggctct cctgctagca gccggatgct ggggacaagt
7921 cactctcacc gtgacggtga catcagcaac acttctgttc tgccattatg cctacatggt
7981 acctggatgg caggctgagg caatgcgctc agcccagcga cgaacagccg ctggaatcat
8041 gaaaaacgct gtggtagacg gcatcgtggc cacggacgtt ccagagctag agcgtaccac
8101 acccatcatg cagaagaagg ttggacaagt tatgctgatt ttggtgtctc ttgccgcatt
8161 ggtggtaaac ccgtctgtga agacagtgcg ggaagccgga attctgatta cggcagcagc
8221 tgttaccctc tgggagaacg gagcaagctc tgtgtggaac gcaacaaccg ccataggact
8281 ttgtcacatc atgcgcggag gctggttatc gtgtttatcc ataacatgga ctcttgtaaa
8341 aaacatggaa aaaccagggc tgaagagagg tgggggcaaaa ggacgcacct tgggggaggt
8401 ttggaaagaa agacttaacc agatgacgaa agaagaattc atcaggtacc gtaaagaagc
8461 catcactgaa gttgaccgct cagcagcaaa acacgctagg aaggaaagga tatcactgg
8521 agggcatcca gtttctagag gcacggcaaa gctaagatgg ctggtcgaga ggaggtttct
8581 tgaaccggtc ggaaaagtga tcgaccttgg atgtggaaga ggcggctggt gttattacat
8641 ggccacacaa aaaagagtcc aagaagtcag agggtacaca aaaggtggtc ccggacatga
8701 agagccccag ctagtgcaga gctatggatg gaacattgtc accatgaaga gtggggtgga
8761 tgtgttctat aggccttctg aatgttgtga cactctcctt tgtgatatcg gagagtcctc
8821 atcaagtgct gaagttgaag aacatagaac gctacgagtc cttgaaatgg tggaagactg
8881 gttgcatcga gggccaaagg aattttgtgt gaaggtactg tgccccctaca tgccaaaggt
8941 catagaaaag atggagctgc tccaacgccg gtatggcggg ggattggtta ggaacccact
9001 ctcacggaat tccacacatg aaatgtattg ggtgagtcga gcctcaggca atgtggtgca
9061 ctcagtgaac atgaccagcc aggtactctt aggaaggatg gagaagaaga cctggaaggg

FIG. 40 cont.

```
9121 acctcagtac gaagaagacg tgaacttggg aagcggaacg agagcagtgg gaaaacctct
9181 actcaactca gacaccagca agataaagaa caggattgaa cgacttaggc gtgagtacag
9241 ctcgacatgg catcatgatg agaaccaccc atatagaacc tggaactacc acggtagcta
9301 cgaagtgaag ccaacaggct ctgcaagctc actggtcaat ggagtggtca ggctcctctc
9361 gaaaccatgg gacaccatca caaatgtcac cacaatggcc atgacggaca ccaccccttt
9421 tggcaacag cgagtgttca aagagaaggt ggacacgaaa gctccggaac cgccagaagg
9481 agtgaagtat gtgctcaatg aaaccaccaa ctggttgtgg gcgttcctgg cacgagaaaa
9541 gcgtcccaga atgtgctcgc gagaggaatt tataaggaag gtcaatagta atgcagctct
9601 gggcgccatg tttgaggagc agaatcaatg gaggagtgct agagaagcgg ttgaagatcc
9661 aaaattctgg gaaatggtgg atgaagagcg tgaggcgcac ttacgcggag aatgtcatac
9721 ttgcatttac aacatgatgg gaaagaggga gaaaaaaccc ggagagtttg ggaaagccaa
9781 gggaagcagg gccatctggt ttatgtggct gggagctcgc ttcctagagt ttgaggctct
9841 gggctttctt aatgaggacc actggcttgg aagaaagaac tcggggggcg gggtcgaggg
9901 tctgggcctc cagaaattag gctacatcct gcgtgaagtt ggcacccgac ccggaggcag
9961 aatctacgct gatgacacag ccggttggga cacccgcatc acaagagctg acctggagaa
10021 tgaagccaag gttcttgagt tgttggacgg ggagcaccgg cgcctggcca gggccatcat
10081 tgagctcacc tatcgccaca agtagtgaa ggtaatgcgc ccggctgctg atggaagaac
10141 cgtcatggac gtcatctcca gggaagacca gagaggaagt gggcaagttg tcacctacgc
10201 tctaaacacc tttaccaacc tggctgtcca attggtgaga atgatggaag gagagggtgt
10261 gatcggccca gatgatgtgg agaaactcac aaaggggaaa gggcccaagg ttagaacctg
10321 gctgtctgag aatgggggag aaagactcag ccgcatggct gtcagtggag atgactgtgt
10381 ggtaaagccc ttggatgatc gctttgccac ctctctccac tttctcaacg ccatgtcaaa
10441 ggtgcgcaag gacatccaag agtggaaacc atcaaccgga tggtatgatt ggcagcaagt
10501 tccattctgt tcaaaccact tcactgaact gatcatgaaa gatggaagaa cactggtgac
10561 tccatgccga gggcaggatg agttagtggg cagagctcgc atctccccag gggctggatg
10621 gaatgttcga gacactgctt gcttagccaa atcttatgct cagatgtggt tgctcctgta
10681 cttccacaga agagatctgc ggttgatggc caacgccatc tgctctgccg tacctgtaaa
10741 ctgggtccct actggaagaa ccacatggtc catccacgct ggaggagagt ggatgacaac
10801 ggaagacatg ctggaggtct ggaatcgtgt ctggattgag gaaaatgaat ggatggagga
10861 caaaaccca gtggagaagt ggagtgatgt tccatactct ggcaaacgag aggacatttg
10921 gtgtggcagc ctgattggca caagagcccg ggccacgtgg gcagaaaaca ttcaagtggc
10981 catcaaccaa gtcagatcaa taattggaga tgagaaatat gtggattaca tgagttcatt
11041 gaagagatat gaagacacaa cattggttga ggatacagta ttgtaaatac tttgttaatt
11101 gtaaataaat attgttatta tgtgtagaag tttagcttta taatagtgtt tagtgtgttt
11161 agagttagaa aaattttagt gaggaagtca ggccggaaaa ttcccgccac cggaagttga
11221 gtagacggtg ctgcctgcga ctcaacccca ggaggactgg gtgaacaaag ctgcgaagtg
11281 atccatgtaa gccctcagaa ccgtctcgga aagaggaccc cacatgttgt agcttcaagg
11341 cccaatgtca gaccacgcca tggcgtgcca ctctgcggag agtgcagtct gcgacagtgc
11401 cccaggagga ctgggtgaac aaaggcgaat caacgtccca cgcggcccta gctctggcaa
11461 tggtgttaac cagagtgaaa ggactagagg ttagaggaga ccccgcgttc tgaagtgcac
11521 ggcccagcct ggctgaagct gtaggtcagg ggaaggacta gaggttagtg gagaccccgt
11581 gccgcaaaac accacaacaa cacagcatat tgacacctgg gatagactag gagatcttct
11641 gctctgcaca accagccaca cggcacagtg cgccgacaat ggtggctggt ggtgcgagaa
11701 cacaggatct
```

>SEQ ID NO:32   BinJV/WNV$_{KUNV}$-EDIII chimeric ISF protein

```
MVTKLRRPVKRAVDMMRRAVPRAAGPRRVLTRVSNTVKRNAGALRALLAYLLYQTFSGR
KVGSGARSALKRFNKNDIVKMLLAFRRTLTNIITTMQRRVKGKKRRGVQDVPLLVLLLVGA
GAMAATLRTVGDLTWLNVSTTDVGKWIRVENRHGKGECFVTATDVGTWCSDSVGYECPQI
APAYDPEDLDCYCRNTSTYVTYGRCKNGRSGRSRSKRAITIAPHGEAGLRVGSTKHWTSRA
TPQRYLMRVEKWVLRHPLPALVLVVLGWMMGRSHGQRAMYIVLMLLVAPSYGNQCLDV
QSRDFVQGVSGGTWVDVVLDHDNCITIVADGKPSFDIRLSKMSMSKFAEYKRYCLQATMSD
VTSIVACPGAGDAHNDKSKNHEYICKAVNNDRGWGNGCVLFGKGSMETCGKFECKKKMA
GKLVARENVESVVTVHVHGASATDTKGVDTASTAKATITPKASVATLNLNDFGSLEVDCST
DVGMDFGEIVVADMSGKWWIVNKDWFNELALPWSTASTTAEVWQARDRLVEFGWPHAA
KQNIYDIGDQEGAVTAAIAQAPMAKWESDKVELISGILKCKVKLGNLKLKGTTYGVCSKAF
RFLGTPADTGHGTVVLELQYTGTDGPCKIPISSVASLNDLTPVGRLVTVNPFVSVSTANAKV
LIELEPPFGDSYIVVGRGEQQINHHWHKSGSSIGNAFTATYKGITKLTVLGEHAWDFNSLGGF
GASLGKAVHTLFGGVFRVMFGGMGWLTKIFVGAVLVWLGLGAHDKTIATTMILVGSILMY
MAVTVGALSEIGCSLDISRKEMKCGDGVFIFREAGMWKDGYAFHPSEPKSLAASVLKSWQS
GVCGVRSTNRMEHAMWKQIENELNGILEENEAQLSVVVRESNGTFPRGERRMHVAEPLRY
GWKTWGKTAISTVPLAKETFVVDGNDEGECPSQMRAWNSFQVEEFGTGLVKTKVFLDISTA
LTAQCDTKMLGAAIKGNRSVHGDPGLWMVSAEIDGTWQIIELTLAESRRCTWPDSHTVWG
RNVQESELILPPSFGGPMTNMNKRKGYATQVGGPWNHVPLRVVFEECPGTTVSVEPNCTRR
SDSVRSTTDSGKIITDWCCRSCTMPPLTYRTPDGCWYAMEIRPKNVKEESLIRSHVAAGVFK
GIDDVSLGLLVMIIFLQEGLRRKLTATYIMWAALVVLIAGILGELTVRDVLRYLILVGTAFAE
SNNGGDLIHLALVAVFKIRPAFLFGFLFRSQWSPREGVLLASGALMLQIASECLHASAIMQV
VDSLSMGWLMIRAIAVPGMTSKAMPLLCACIPAVTSLLAHSTRAGIITMAGMSLIAGSKGSS
VKKHSPYMLALVVAGLGARPIGMLAMEAFSHLKGRRSWPAGEMMSAVGLTCALVGAISG
ASSQDFAGPLAAAALIIIAYAISGRSADVYLEKAGEISWSEDAKISGSSPRIDVCVTENGDFKL
RHESEATWTRNCVLAACLVVAGVHPLGIPVAGLMWFGYVKSNKRGTVLWDIPSPQATSAP
TVEDGCYRVMSRRLLGSTQLGVGIMLDSTFHTMWHITRGASIVSGEGRLDPYWADVKEDL
VCYGGPWKIRNTWDGLSEVQLIAVAPKENPVNVQTMPGKFIVANGGEIGAVVLDYPPGTSG
SPIVDQQGNVIGLYGNGVMINDQTYASAIAQAPAEVARTPTWFTDDMLRKGQLHVLDLHPG
AGKTRKVLPEILKAAVEKRLRTLVLAPTRVVAKEMHEALTGLPVRYQTSAVAPNGSGGELI
DVMCHATYTHRQLTPGRGVNYQLYIVDEAHFTDPASIAARGIIATRVRLGHAAAIFMTATPP
GMSNPFPESNAHIEDEEREVPTKAWNAGYEWITDYGGKTVWFVPSIRMANTIAACLVRAGK
TVIVLHSGSFNEEYQKTKSGNWDFVVTTDISEMGANFKASRVIDSRLSIKPMFSYAPSERVVI
GSPRAVSPASAAQRRGRVGRDPRQLGDQYIYGGPVGEDSAEFVHWKEARILMDNVTVPGG
LYPQFYEPEGGMCDAMDGAHRLTDAKREVFRDLMKKGELPVWLAYQVAQAGHAYTDRT
WCYGGPADHQVYDDCGQTVDYRSLNGERRMLRPKWLDQRTYNDKTSLRLFTEFAEGRRR
YSELMDVFGRMPQHMLDRTILAADTFKDVLTATPGSRVHRLALDNLPEATETMMVVGILSV
STLGVMLFLMSPKGMTRMTCGLVVIILATYFLWVSGMAGYQIAAMQLIAFILFVVLVPEPGS
QRSVQDNTIAIILIVILSLAAIIAANEAGLLEKTKKDFAWKRESHVLVTPSPWNLDFSMDLRPA
TSWSLYVVMATMLGPVLEHAIVTNYASVSLTAITNQAGILLSMDKGTPFWNLDWSVVLLCV
GSWSGINGTTLMVASTMTVLHFAMILPGIRAKAAREAQNRTAAGVSKNPLIDGLNTINIQPL
PEMDPMYERKMGLWMLIAVAGAAVVFDKRMLHYTEFGVLGSAAVSPLIEGYASAVWNTS
VAASVCNLMRGHYMAGIPMAYSLIRNLSMKGVPRRGLQATHTLGMVWKHKLNAMDKAA
FNAYRKDGVTEVDREPAREAMKKGDLVSGWAVSRGSAKLRWMHERGYIPLQGVVIDLGC
GRGGWSYYAAAQRRVTAVKGLTKGGPGHEEPINVQSYGWNLVTFRSGVDVFHTEVQPADT
LLCDIGESSADPAVEKARTVQVLVNFERWIRESRCEHFCCKVLGPYSPEVMERLDRLTKTYG
GAVIRNPLSRNSTHEMYWVSGAKGNPVNAITATSRVLIERMYRRLGKSYWEEDVNLGTGTR
AVSCAAEKPDLAKIGRRIELLKKEYKASWFEDPEHPYKTWTYHGSYETKTTGSSSSMINGVV
KEITHPWDTNPRVTTVCMTDTTPFGQQRVFKEKVDTKAREPSQGTREIMRIVSKWLTLYIGR
SKRPRLCTADEFIAKVNADAALGTMFDSQGNWANAKEAVRDPRFWQLVAKERELHLRGQC
ATCVYNMMGKREKKLTEFGKSKGSRAIWFMWLGARFLEFESLGFLNEDHWLSRENSGGGV
EGIGLQYLGYVLKEMALIPGGKMYADDTAGWDTRITNADLEDEMDILGLMDPHHKKLAKN
LMELAYNNKVVRVMRPGKGGKTLMDIISRKDQRGSGQVVTYPLNTWTNLKVQLIRMAESE
GVLDPKEIDGITVTTRNNLEKWLTSQGAERLKRIAASGDDVVVKPVDERFANALTYLNDMA
KIRKDISEWKPSAGWFHWEEVPFCSHHFHQLVLKDGRTLVVPCRDQDELIGRARVSPGAGW
TIRETAGLSKAYAQMWLLMHFHRRDLRMAGFAICSAVPSDWVPTGRTSWSLHAKGEWMT
TEDMLAVWNRVWIEDNPHMSNKTLVGSWQDIPYQRKSLDIHCGSMIGQRSRSTWAANIRISI
GHVRRLIGTTEKYLDYMQEQERFKIAEPTRLGNVI
```

FIG. 41

SEQ ID NO:33     BinJV/WNV$_{KUN}$-EDIII chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg acaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tatattttgc gtgtgcgttt caaaacacag attgtattga aagtacgtaa gagtataaca
1021 cgttggaata aagttttgga tcaagaggaa aatcatggtt acaaaactca ggaggcccgt
1081 taaacgggcc gtcgatatga tgaggcgcgc ggtaccccgc gccgcaggac cccggcgggt
1141 cctaactagg gtatcaaata ccgtgaagcg taacgcaggc gctcttagag ctcttctggc
1201 ttatctgctg taccagacat tctctgggcg gaaagttggt agtggtgctc ggagcgccct
1261 taagcgcttc aacaaaaatg acattgtgaa atgttgctg gcgttcagac ggacattgac
1321 aaacatcatc acaaccatgc agcgtcgtgt gaaaggaaag aaacgtcgtg gcgttcaaga
1381 tgtgccgcta ttggtcttgc tgctcgttgg agcaggagcg atggctgcca ctttacgcac
1441 cgttggagac ttgacatggc taaatgtgtc aaccactgat gttggaaagt ggatacgtgt
1501 ggagaatagg cacggcaaag gagagtgttt cgtcacggcc actgacgttg aacatggtg
1561 ctcagactct gtgggatatg aatgtcctca aattgcaccg gcgtatgacc ctgaagactt
1621 ggattgctac tgccgaaaca cctcaaccta cgttacttat ggaaggtgta aaaatgggcg
1681 cagtggacga tctcgcagca agagagcaat cacgatagcc ccgcacggcg aagcaggatt
1741 gcgtgttgga agcaccaagc attggacttc tagagcaact ccacaacggt atcaatgcg
1801 cgttgagaaa tgggtgctgc ggcatcctct acctgctctc gtgttggtgg tactgggatg
1861 gatgatgggt cgttctcacg gccagagggc catgtatata gtgctgatgc tgcttgtggc
1921 tccgtcatat ggtaaccaat gcctggatgt gcagtcacgt gatttcgtgc aaggggttag
1981 tggtggcacc tgggtagatg ttgttttgga tcatgacaat tgcataacca ttgttgctga
2041 cgggaaacca tcttttgata ttcgtttgtc gaaaatgagc atgtctaaat tcgcagagta
2101 caaacggtat tgcctccagg ccacgatgag tgatgtcact agcatagtgg cgtgtccagg
2161 ggctggggat gctcataatg acaagagcaa aaaccacgag tacatttgca aagctgttaa
2221 caatgaccgc ggatggggca atgggtgtgt ccttttttggc aaaggatcaa tggaaacttg
2281 tggtaagttt gaatgtaaga agaaaatggc tggcaagtta gtggcacgtg agaacgtgga
2341 atcagtggtc actgtgcatg tacatggtgc ctccgcaact gacacaaaag gagttgacac
2401 cgcctctaca gccaaagcga ctatcacgcc aaaagcttct gtggctactc taaatttaaa
2461 cgactttggt agcctggagg tggattgttc aactgatgtt ggcatggact ttgagagat
2521 tgtggtggcc gacatgtcag gaaagtggtg gatcgtgaac aaggattggt tcaatgaact
2581 tgctttgccg tggtccacgg ctagcaccac tgctgaagtt tggcaggcac gagacagact
2641 tgttgagttt ggatggccac atgcggccaa gcagaacatc tatgacattg ggaccaaga
2701 aggagctgtg acggctgcca tagcccaggc acccatggcg aatgggagt ctgacaaggt
2761 cgagctaatc tctgggattc tcaagtgcaa ggtgaaactt ggcaacctaa agctgaaggg
2821 gacaacttat ggcgtctgtt caaaggcctt cagattcctt gggactcccg cagacacggg
2881 ccatggtact gtggtactgg aactgcagta caggcacg gatggaccct gcaagatacc
2941 catttcatca gtagcttcat tgaatgacct aacgccagtg ggcaggttag ttaccgtcaa
```

FIG. 42

```
3001 cccctttgtc tccgtgtcaa cggccaatgc taaagtcctg attgagttgg aaccaccctt
3061 tggagattcg tacatagtgg tgggaagagg agagcaacag atcaaccatc actggcacaa
3121 gtctggtagc tcgataggaa atgcctttac ggccacttac aagggcatca caaaattgac
3181 agtgcttgga gaacatgcct gggattttaa ttcactaggt gggtttggag caagccttgg
3241 gaaggcggtc catacactgt ttggaggtgt attccgggtg atgttcggag gcatgggatg
3301 gttaaccaag atctttgtgg gtgctgtcct agtctggcta ggattaggag ctcatgacaa
3361 gacgatcgcc accaccatga tcctggtagg atccatactg atgtacatgg cagtgaccgt
3421 gggtgcccta tcggaaatag gatgcagtct ggacattagc cgaaaagaaa tgaagtgtgg
3481 ggacggagtc ttcatcttca gagaggcagg catgtggaag gatgggtatg cgttccaccc
3541 ttccgaaccc aaatctctgg ccgcgtcagt tctcaagagt tggcagtctg gagtgtgcgg
3601 cgtgcgctcc acgaacagaa tggaacatgc catgtggaaa cagattgaaa atgaattgaa
3661 cggcattcta gaagagaatg aggcgcaact cagcgtggtt gtgcgagagt ctaacgggac
3721 cttcccgaga ggagagcgcc gcatgcacgt ggccgaacct ctgcgctatg gatggaagac
3781 ctggggaaag accgcaattt cgacggtgcc gctcgctaaa gaaacgtttg tggtagatgg
3841 caatgatgaa ggagaatgtc cctctcaaat gcgtgcttgg aattccttcc aagttgaaga
3901 gttcggaact gggctggtga aaaccaaagt gttcttggac atatccactg ctctcaccgc
3961 ccaatgtgac accaaaatgc tgggcgctgc cataaagggg aataggtctg ttcatggaga
4021 tccaggtctc tggatggtct cagctgaaat cgatgggaca tggcagataa tagagctcac
4081 attggcagag agcaggcgtt gcacatggcc agactctcac accgtgtggg gtaggaatgt
4141 ccaggagagt gagttgatac tgccaccgtc tttcggagga ccgatgacca acatgaacaa
4201 gcgtaaaggc tacgcgaccc aagtgggagg accatggaac catgttccac tacgagtagt
4261 ttttgaagag tgtccgggaa ccactgtatc tgttgaacca aactgcacca ggagatcgga
4321 ttcagtgcga tccacaactg atagcggcaa gattataacc gactggtgtt gtcgttcctg
4381 tacaatgcct cccctaacgt accgaacccc cgatggatgc tggtatgcaa tggaaatcag
4441 gcccaagaat gttaaagagg agagtctgat ccgttcgcat gtggcggcag gtgtgtttaa
4501 aggcattgac gacgtgtcac tggggctgtt agtaatgata attttcctgc aggaaggttt
4561 gagaagaaag ttaactgcaa cgtatatcat gtgggctgct cttgtggtcc tcattgcagg
4621 aatcctaggg gaactcacag tgagggatgt gctcaggtat ctcatcctag tcggcactgc
4681 attcgctgag agtaataatg gaggagattt aatacatctg gccctagtgg cggtcttcaa
4741 gattaggccg gcattcttat ttgattctt gttcaggagt cagtggtccc ccagagaagg
4801 tgtgttgctg gcatctggag cgctgatgct gcagattgca agtgagtgct tgcacgcatc
4861 ggcgattatg caggttgtcg attccttgag catggggtgg ttgatgatca gagccattgc
4921 tgtacctggt atgacctcaa aagccatgcc actgctgtgt gcctgcattc ctgcagttac
4981 gagcctactg gcccactcaa ccagagccgg tataatcacc atggccggca tgtcgcttat
5041 tgcaggaagt aagggatcat cagttaaaaa acacagtcca tacatgcttg ccctcgtggt
5101 ggcaggcctc ggagcccgtc ccataggaat gttggcgatg gaagccttct ctcacctgaa
5161 gggccggaga tcatggccgg ctggtgagat gatgtcagcc gttgggctga catgtgcgct
5221 agtgggagct atcagtggcg catcatctca ggacttcgcc ggacctctag cagcagcggc
5281 tctaattatt attgcatatg ccattagtgg acgctcagct gatgtatacc ttgagaaagc
5341 cggtgagata tcctggagtg aggacgctaa aatatccgga tcaagcccgc gcattgatgt
5401 gtgcgttacc gaaaatggag atttcaaatt gcgtcatgag agtgaagcaa cctggaccog
5461 gaattgtgtc ttggctgctt gcttagtcgt agccggagtg cacccactgg ggattccagt
5521 agcagggtg atgtggtttg gatatgtgaa atcaaacaag cggggactg tgttgtggga
5581 cattccctca ccacaggcaa catcagctcc aacggtggaa gatggatgct accgcgttat
5641 gtcacgtaga ctgcttggca gcactcagct tggtgttggg atcatgctag actctacatt
5701 tcacacaatg tggcacataa cccgaggagc atctattgtt agtggtgaag ggcgtcttga
5761 cccatattgg gctgacgtta aggaagacct ggtctgttac ggagggccat ggaaaatccg
5821 caacacatgg gatggactct cagaagttca gctgatagcg gtggccccaa aagagaatcc
5881 cgtgaacgtc caaacaatgc caggaaagtt cattgtggcg aatggaggtg agataggagc
5941 cgttgtgctc gactatcctc ctgaacttc tggttcaccc atcgtggatc agcagggtaa
6001 tgtcatagga ctgtatggca acgggggttat gatcaatgac caaacgtatg cgagtgccat
```

FIG. 42 cont.

```
6061 tgcgcaagct ccagctgaag ttgcgcgcac cccaacctgg ttcactgatg atatgttgcg
6121 aaagggacaa ttgcatgtgc tagacttgca ccctggagcg ggaaaaaccc gcaaggtcct
6181 gcctgagatt ctcaaagcag cggtggagaa acggctacgc acgttggtcc tggccccaac
6241 cagagttgtg gcaaaggaaa tgcatgaagc attgaccggg ctgccggtac gctaccagac
6301 atcagcagtg gcaccaaatg gttctggagg agaattgatt gatgtcatgt gccatgcaac
6361 atacacacac cgccagctga caccgggacg gggggtcaac taccagttat acatagtgga
6421 tgaggcacat tttacagatc ccgcttccat cgcagctcgc ggcatcattg cgactagggt
6481 gcgattggga catgccgcag caatcttcat gacggccaca cccccgggaa tgtcaaaccc
6541 attcccggag tctaatgctc acattgaaga cgaagagcgg gaggtaccca ccaaagcttg
6601 gaacgctgga tatgagtgga taacagacta tgggggaaaa accgtgtggt tcgtgccttc
6661 catccggatg gcgaacacca tagctgcatg cttggtacga gcaggcaaga cagtcattgt
6721 actgcacagt ggctctttca atgaagaata tcaaaaaacc aagtctggca attgggattt
6781 cgttgtgacg accgacatct cagaaatggg ggccaatttc aaagcctcta gggtcataga
6841 ctctagactg tccataaaac cgatgttttc ctacgctccc agtgagcgag tggttattgg
6901 ctcacctaga gcggtttctc cagccagcgc agcacagcgc cgagggagag tcgggagaga
6961 ccctcgtcaa ctgggcgacc agtatatcta tggtggacca gtaggagaag actcggccga
7021 gttcgttcat tggaaggaag caaggatcct catggataat gtaactgtcc ctgggggctt
7081 gtatccacaa ttctacgaac cagagggtgg aatgtgtgac gccatggatg gagctcaccg
7141 actgaccgat gctaagagag aagtgttccg agacctcatg aagaagggg aacttcctgt
7201 atggttagca taccaggtgg cccaggctgg gcatgcgtac actgacagaa cttggtgcta
7261 tgggggccg gcggatcatc aagtgtatga tgattgcggc caaaccgtgg attacaggtc
7321 ccttaatgga gagaggcgta tgctacgtcc caagtggctt gatcagcgca cctacaacga
7381 caaaacatcc ttaaggctct tcacggaatt tgcagaggga cgccgccgat attcggaact
7441 aatggacgtg tttggaagaa tgccccaaca catgttggac aggaccatct tggctgcaga
7501 cacgttaaa gatgtcctga cagcaacacc gggatctcgt gtgcaccgtt tagcactgga
7561 caatttaccc gaagctacag aaactatgat ggtagtggga atcctgagtg tctcgacccct
7621 aggcgttatg ctatttctga tgtcacccaa gggcatgacc cggatgacct gcggacttgt
7681 ggtgatcatc ctggcgacgt attttctatg ggtgtcagga atggccggct accagatagc
7741 agcaatgcaa ctcatcgcgt tcattctgtt tgtggtcttg gtgccagagc cagggtcaca
7801 gagatcagtg caagacaaca ccatagcgat aattctcata gtcatcctgt cgttggctgc
7861 catcatagcc gccaatgaag caggattgct agagaagacc aaaaaggatt cgcgtggaa
7921 gagggagagt catgtgctgg tgactccgag tccgtggaac ctggatttct caatggattt
7981 gaggccagcc accagctggt cattgtatgt ggtgatggcc accatgttag gccagtact
8041 ggaacacgcc attgtcacca attatgctag cgtctcactt actgccatca caaaccaggc
8101 aggaatactg ctgtcaatgg ataagggcac tcctttctgg aatcttgact ggagtgttgt
8161 cctgttgtgc gtgggcagct ggtcggggat caatggcact acactaatgg ttgcttccac
8221 aatgacagtt ttgcattttg ccatgatact acctggcatt cgtgccaaag cggcgagaga
8281 agcacagaat cgaacagcag ctgggggtgtc aaagaaccct cttattgatg ggttaaacac
8341 cataaacatc cagccgttgc cggaaatgga ccccatgtac gaaaggaaaa tgggggctatg
8401 gatgctaatc gctgttgccg gagccgcggt ggtttttgac aagagaatgc tccattacac
8461 cgagttcgga gtattgggtt cagctgctgt gagtcctctc attgaaggat acgcgtctgc
8521 tgtttggaac acttccgtag cagccagtgt gtgcaaccta atgcgaggcc attacatggc
8581 gggaatccca atggcatact ctctgatcag aaatctatcc atgaaaggag ttcctaggag
8641 gggattacag gccacccata cccttggtat ggtttggaaa cacaaattaa cgccatggga
8701 caaggcggcc tttaacgcat accggaagga tggagtgaca gaagtggata gggagccagc
8761 acgtgaagct atgaagaaag gagatttggt gagcggatgg gcggtctctc gagggtcagc
8821 caagctgcga tggatgcacg agcgtggata cattccccta caaggagttg tcattgacct
8881 cggatgtgga agagggggt ggagttacta cgctgctgca caacgccggg tgaccgctgt
8941 caaagggctc acgaaaggcg gaccagggca tgaggagcca atcaacgtcc agtcatatgg
9001 atggaactta gtgacgttcc gtagtggagt ggatgtcttt cacaccgaag tccagccggc
9061 tgacacccctg ttgtgcgaca taggagagtc ttctgctgac cccgctgtcg aaaaagcgcg
```

FIG. 42 cont.

9121 cacagtacaa gtgttggtga actttgaaag atggattaga gagtcgcggt gtgagcattt
9181 ttgttgcaag gtgcttggtc cctactctcc cgaagtgatg gagcgcttag atcgtttaac
9241 aaagacatat ggaggagcgg taattcgcaa cccactatcc aggaactcca cgcatgagat
9301 gtactgggtg tcaggagcta agggtaatcc agtcaatgct ataacagcca cctcacgtgt
9361 gctaatcgaa cgcatgtaca gaagacttgg caagagttac tgggaagaag atgtgaatct
9421 tggtactggg acccgtgcag tttcatgtgc cgcggagaag ccagatctag caaaaatcgg
9481 aaggcgcatt gagttgctga agaaggagta taaagcatca tggttcgagg atccagagca
9541 tccctacaag acatggacat accatggttc ctacgaaacc aagaccacag gcagctcgtc
9601 tagtatgatt aatggcgttg tcaaggagat cactcaccct tgggatacca acccaagggt
9661 tacaaccgtc tgtatgaccg acaccactcc ttttggacag cagagagtat tcaaggaaaa
9721 ggtagatacc aaggcacgtg agccatctca agggacgcgg gagatcatga gaatagtgag
9781 caagtggctc acactatata ttggtcggag caagcgccct aggctgtgca cagcggatga
9841 attcatagcc aaagttaatg ctgatgccgc tctcggcacg atgttcgact cgcagggaaa
9901 ctgggcgaac gccaagaag ctgtgcgcga cccacgtttt tggcagttgg tggccaaaga
9961 gagggaactt cacctgcgtg gacagtgtgc cacgtgtgtt tacaacatga tggggaagcg
10021 agagaaaaag ctgacagagt ttgggaagtc gaaggggagc cgagcaattt ggtttatgtg
10081 gctaggagct aggttcttgg agtttgaaag tttaggcttc ctaaacgagg atcattggtt
10141 gtcacgtgaa aactcaggag gtggagttga gggcattgga ttgcaatacc ttgggtatgt
10201 gttgaaagaa atggcactaa ttcccggggg caagatgtac gccgatgaca ccgctgggtg
10261 ggacaccaga attactaacg ctgaccttga ggatgagatg gacatattgg gacttatgga
10321 cccgcatcac aaaaaactgg caaaaaatct gatggagttg gcgtacaaca caaggtggt
10381 cagagtgatg cgccctggta aagggggaaa aacactaatg gacatcatta gccgcaagga
10441 ccagcgggga agtggacaag tggtcaccta cccactcaac acgtggacga atctcaaggt
10501 ccaattgatc cgtatggcag agtcagaggg agtgttggac cccaaggaga tcgatggaat
10561 cactgtcacg actcggaata acctggaaaa atggctcact agccaagggg ctgagcgtct
10621 aaagcgcatt gcagctagcg gtgacgacgt tgtggtaaaa ccagtggatg agagattcgc
10681 caatgctctc acctatctaa acgacatggc caaaattagg aaggacatca gtgagtggaa
10741 accatccgcg gggtggttcc actgggaaga agtgccattc tgctcacacc attttcacca
10801 gttggtcctc aaggatgggc gcaccttagt ggtcccatgc cgtgaccagg atgaactaat
10861 tggaagggca agagtgtcac ctggtgctgg atggactatc agagaaactg caggtctaag
10921 caaggcctat gcccagatgt ggcttctaat gcacttccac cggagggacc tcagaatggc
10981 aggtttcgcc atttgtagtg ctgtccccag tgattgggtg cccacgggaa ggacatcgtg
11041 gtcactgcac gctaaagggg agtggatgac cactgaagac atgttagcag tttggaacag
11101 agtgtggatt gaagacaatc cccacatgtc taacaagact ttagtgggat catggcaaga
11161 catcccgtac cagaggaaat ccctggacat ccactgtggc tcaatgatag gcagcggtc
11221 taggtcaaca tgggctgcta acatacgaat tagcattgga cacgtgcgcc gattgattgg
11281 aaccacggaa aagtacttgg attacatgca ggagcaggag cggttcaaga ttgctgaacc
11341 aaccegtctg ggcaatgtga tctaaggatc tacgaacgag aataagtaga agaacggaac
11401 gacagagtca ggcctcaaat gagccagcat taatgagagt aagtgctgct gcctgtgcct
11461 ctccttaaca cgtggtagcg ccactcgtgt ttcgttacct aatagcgcta gagtcagacc
11521 caagtaggcc agggctatgg ttgtaagccc tgctgtctgt ggcagccatc cagtggtaat
11581 gcgtcgcacc actaaggatt aatagacgta tattgggagg gactggtgag gagcagcaag
11641 ctcgagctgc atcacccact ggtactatcg gttagaggaa acccctcca aatgtagag
11701 catcatatcg acacctggga aagaccggag atacctcttg cttcacagca ctcaatccac
11761 aaggcacaga tcgccgaata attgtggatt ggggattgag aaacatcaag tatct

FIG. 42 cont.

SEQ ID NO:34 CPEC BgV vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggcccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttata ctcggtggcc tcccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaaccg
 961 taaaatccgt acgcttgttt tggcacacta gtttgtgaca taaggctttt gtcgcgcgta
1021 ttgggtttaa ctttttttcg agaaatcgag aggtaagaag aattgaaaga cattatgtct
1081 aacccttccg tcaggagggg tgtcaatgtg atggcggctc agaaaaaacg agtcgcccaa
1141 aaaataaaat caatgaggaa gggaacccag agcatcagca atggagttag gggtttcatc
1201 ctcttttca tatcccaaat cttctgggca cgtaagatca cgcccagagt gaaaggattg
1261 tggaaaaaac tagacaaatt tcaggcaatg aaggttttga aagggctaag aacatcatc
1321 aatggattga tgagatcggt cgctgggaaa aagaaacgcc gtggagggaa taccgtgcca
1381 ttcttagtga tgatgatggt agcaacaaca tgggccttaa ctctcaggaa gattgacaac
1441 actattgttc tgaatgtcac ccaaaatgac atagggaaaa catttcctgt aaggggcggt
1501 aattgttcca ttaacatcaa tgatgctgga tactggtgtc acaatacagt cgaatatgat
1561 tgtgtcacca tagctggtac ggaagagcct gacgacattg attgctggtg tgttggcatt
1621 gaaggagtga gagtgactta cgggaaatgt tcaaagtcat caccgcacgg gaggagatct
1681 cgtagagcag cagtcattcc cgcgcatggt gggcagggac tatcaaccca taaagagaca
1741 tggctatcca ctgtagcagg ggaaaggcaa atccaacgta tagaaagatg gatcattcgc
1801 aatcctcttt atgccgctgc aatggtgact gtggcgtatt ttctgggaag tgacaccaaa
1861 cagaaagtgc tgttagctgt gttaatgttg gcaattggac ctgcttacgg ctctcactgc
1921 attggaattg aacggcgtga ctttgttcat ggagttcagg aagcacatg ggtaaatcta
1981 gtgctggacc agggatcttg cgtgaccatg gtgactgaaa caagccaag tgtggatgtg
2041 tggctcaagg aaatctcttt gagtcaaccc accttggtta ggagatatag ccacacagca
2101 aaggtccata aaacagaaat caaagctgct tgtcccacaa tgggagaggc caaacttgat
2161 actgaacaca catccgtcgta tgaatgcaag cgcacttatt cggatagagg ttggggaaac
2221 ggttgtggtc tgttcggaaa gggtagcatc attgcatgcg ccgagttttc tcaacgggc
2281 catatggatg tttatgaaat tgacatgacc aagattgagt acatcgtgaa ctcgcagatt
2341 catggaactg tgctcgttga gaacaattcc cagcatgcag tagagtcaaa gttccagcca
2401 acaacaggag gagctgaagt cacacatgca gggtatggca cacttggctt ggactgtcat
2461 gtacaaacca tgatggatct gaacaacttc tatctggctg tcatggggatc cgatgcatgg
2521 ctagtgcaca agcaatgggt ggaagatttg acattacct ggatggcagg tgaaactgga
2581 cactggaaag aaaagaata tctagttgaa tttggtgaac cacatgccac gaagatggaa
2641 gcccttgttt taggttccca ggaggggggct ttgaggactg cccttgctgg agctatggtc
2701 gtggtgtact cccaaaatga caaaaattc actctgaagg ggggtcatgt gagttgtaga
2761 gcaagattga ctgacctgac attgaaagga acatcatatc caatgtgcaa gggctccctc
2821 aagttcacaa agactccagt tgacaccgga catggaacag cagtgatgca tgtgcaagtg
2881 acgaaagggg caccatgcag aataggagtc caaatggctg acaactcaaa tggaggaaag
2941 tcgttgggaa gcatgattac atcaaaccca atagtctcca ctgatggtga ggagactctg
```

FIG. 43

```
3001 gttgaagttt ctcccccata tggagaaagt tacatcatag tgggatcagg cgatggcaag
3061 ttggtttacc attggcacaa gactggaagc actattggga gcctgttctc agaaaccatg
3121 aaaggagcta agagattggc aatcctaggt gatgacgcat gggacttctc ctcaacggga
3181 ggggtcttag cctcagttgg gaaaatgctg catactgtgt ttggacaagc tttccatgca
3241 atctttggag ggttgagttg gatttcaaaa ataattctag gttgtgttat gttgtggata
3301 ggtgtgaact cccgcaatgg cacattgagt gtcaccttgt tgactgttgg cggcattctg
3361 ttgttcatga cacttggagt taacgctgag tacggttgct cattggactt ccaaaggaaa
3421 gaactgaagt gcggcgatgg agttttcgtg ttcaatgatg ccaatgattg gttgaccaag
3481 tacagatatc atcctgaaga cccacgaaca ttggcttctc tggtcaaggc ttcatataag
3541 gccggacggt gtgggcttgg atcagttgac aacatggaac ataagatgtg ggtgtccctg
3601 gaaaatgagt tgaatgccat ctttgaggaa aaccaagaaa atatctcagt ggtagtgaag
3661 gagagtaatg gaatataccc caaaggaaat tatccattca ctggcactcc agaaaagctg
3721 aaatatggat ggaaaacatg ggggaagaaa ttggtatttg ccccggtttt gagtaacaac
3781 acctttgtaa tagatggaac tcccgatgat tgtccttaca gcaacagagt ttggaattca
3841 tttgagattg atgagttcgg agcaggtttg actcatacca gggtgttttt gaaacaaaga
3901 ctggaaagaa aagaagagtg tgacaatgca cttttaggag ctgcagccaa aggggacgtg
3961 gcagtccatg gggatcccaa cttctggatg gcctcaaaca aaactggaga agtgtggcag
4021 atcaatgaat taatgtcact aaacctcaag cactgcacat ggcccttgtc tcatacgttg
4081 catggcaatg gagttctgga atcagacatg ttcgttccga aaagcattgg aggaccggtt
4141 agtcaccaca acttcattaa aggctacaaa tctcaggtaa atggaccttg gcatcagtg
4201 cctctagaaa tgcatcggag agagtgccct gacacagtgg ttcaaataga tcagaactgc
4261 agcgggagag gcaagtccac acggagcact acaaaggaag ggaaaataat ccgggattgg
4321 tgttgtcgaa actgcacgct gccccctgtt agctttgatg gtcctgatgg atgctggtat
4381 gctatggaga ttagaccgca gaagatgaat gaaaaacatt tggtcacttc atgggtaagt
4441 gccggtgacg ggatggaaaa tggtaacatt ggattggtgg ctctctttgt gtgctttgac
4501 atgttcttga agaacaagaa caccgaaag attagcttgg ttggagcctt gtgtctattg
4561 ggcgcaatga tccttgggaa tgttggattt gttgatctaa taaaattcat gattgtggtt
4621 ggtgaacatt tccgctcctt caaccatgga ggtgacgtct cctacttggt cctgaccgct
4681 gtcttgaca tcaggccagc cctgctctgc ggctttgtgc tgcgcaagaa atggagtcct
4741 agtgagagag tagtcatggc cattggaatg atgctcctgc aaacggtgtg tggggattgg
4801 actcagacat cttggtggga atggctggat gctgttggat tggggctctt gatcctcaat
4861 gcagtagctt tacaaagatg gaaaccggcc attttggtct tgctgacaat gttgactccg
4921 ctgaatatgc gagtaattca aggtgctgca gggggagtgt gtggcgttat ggtggccatg
4981 tctttgtgga aaacagaagg aagaagtctc cgtaagagtt acctgccagt cattggctat
5041 gttgcttcgg cttttggatg ggggtattca tggatcatgg cagtgtacat catgtgggca
5101 acccatgtgt caaggagatc ttggcctgta ggagagctgg cagcagcaat tggactttg
5161 ggagctgcaa tgggaatggc atccacaaag gatggagcca tggtcatgcc aatagctgtg
5221 ctcggattaa tcatggtgat cataggaatg acaggcaaat gcgatggaat ggagattcgc
5281 aaagttgggt gtgtctcgtg ggaagactcc gctgagatca gtggttcaag ctccaggtat
5341 gacgtggctc ttagtgatgg cggagaattc cagctgttag agaattcgcg gccccccctgg
5401 aatcacatca ttttcctcac cctgggaatg ctggcgtcag cagtgcatcc aatagtactg
5461 ggtgtggtca tacttgcctg ggggtggttt gcaggcaaaa gccagcgcag tggagtttg
5521 tgggacgtgc ctgttgctcc aaaagttgag gaccatggac cccttgagga tggaattac
5581 accattttcc agaatggatt gtttgggagc tcccaggctg gagtaggagt ggctcaggga
5641 ggcgtgtttc acactatgtg gcacgttact cgtggaggaa tcctgctgca caaggtaaa
5701 agactcaccc ctggttgggc tagtgtgaaa agtgacctca tttcgtatgg aggtaaatgg
5761 agacttgatg gaagttggga tggagtcgag gaagttcagt tgattgctgt ccctcccagg
5821 aaaaatccta tcaatgttca aactaagccc agcattttca aattaaagag tggagaggag
5881 atgggagcca tagctttgga ttaccctagt ggaacttcag gatcacccat tgtcaacaga
5941 gctggagtcg ttgtgggggtt gtatggaaat ggaattgtgc tcaatcaggg tggttatgtg
6001 tcagctatta gccaagcagc tgtggaagag gtcagtagag atgagctacc cggaattgaa
```

FIG. 43 cont.

```
6061 ggctacctga gaaaggggca actcaccgtt ctggattttc acccaggggc aggaaagaca
6121 cgtaacttcc tgccccaaat cttgaaggca tgcaggaccc gcaagttgcg aacactagtg
6181 ctggccccaa ccagagtggt tctgagcgaa atgaaggaag ctctgaatga tcacgatgtc
6241 aagtaccaca cacaagcttt ctcatctgcc agttcaggac gtgaactgat tgacgctatg
6301 tgccatgcaa cattggcata tagactattg gaaagcacta gggtgataaa ctgggaggtt
6361 gtgataatgg atgaggctca ctacatggat ccagccagca ttgctgtgag gggttgggct
6421 gcccatagag ctagagctca tgaatgtgca acaatattca tgtcagcgac tcccccaggg
6481 actgcaaatg aatttcctga atcaaatgga ggcattgagg acatccgcaa ggacatcccc
6541 agtgaggctt ggaacaaagg tcatgagtgg atcctagagg atagaaggcc aacggtgtgg
6601 ttcctgccct ctataaggag cgcaaataac attgctgcat gtttgaggaa agccaacaga
6661 acggttgttg tgttaaacag acagaccttt gaaagtgtgt accccactat caagacaaag
6721 aaaccggact tcatcctagc cacagacatt gctgagatgg gggcaaatct tcatgtggaa
6781 agggtaattg actgccgaac tgctttcaag ccagtgctca gtgaggatca ggaacgggta
6841 acactgaaag ggccaatgag aatatcagct ctgcggcag ctcagcgaag aggccgtgtg
6901 gggagagatc catccagaga gtctgacaca tattactatg gagaggcac ctcagaggac
6961 aatgaccatt tggtgtgctg gactgaggcg tctatgattc tggataacat ggaaattaaa
7021 ggggaatgg tggctccgct gtacagcgtg gaagcacaa agaccaaaat gacgccaggt
7081 gagtgtaggc taagagatga tcaaaggaaa acttttagag cattaataaa gaaacatgag
7141 ctgcctgtgt gggtctcatg gaaggtggcc aaagcaggaa tcactccaga tgataggaag
7201 tggtgttttg atggagagga ggacaacacc gtgcttaatg acatggggga gaaggtcatg
7261 ggaagaagcc caggaggtgc aaagaaagct ttgtgcccta ggtggtcaga cgcaaggctg
7321 actagtgaca atgcttccct catgaacttc ctggcatttg ccgaggggag gagatcatac
7381 atgaggatcg ttgacgctct catcatggtg cccctatgc tgaaagaaaa ggtggtggat
7441 gcagcggaca ccttagcact actactgcgt tccgaggagg gcagcagggc ctacaaactt
7501 gctcaggaga gcgctccaga agcgatcaca acactcatca tggtaaccct cctggttctg
7561 ctatcagcag gactggttct gatgctcatg tggccaaaag ggattagcaa gatgtcattg
7621 ggcatgctca ccatgagcgt tgcgggatac cttcttttgg aaggagggct cacccaagtg
7681 caggttgcag gaatattgct ggtgttttc atcttgatgg tggttctaat ccctgatgat
7741 ggctcccaga ggtcaatcaa cgacaacaag ctggcttaca tgatgacagg aattatcctt
7801 cttgttggag ctgttgctgc taatgagatg ggatggcttg aaaaacgaa acaggatttg
7861 tttgggaaaa gggaagaaat gccgggatgg aactgggatt tgggacttga cctaagacct
7921 ggagcagcct ggaccactta tgtggctctg gcgactgtcc ttgcccagt gatagaccat
7981 tggatacaag tggaatatgg aagcgctagt ttgactggca tagccaattc agcaggcatt
8041 tccgcatttc tggacaaggg ggttccttc atgaaggtca acatggcagt ggtggttctg
8101 tttgtgagcg catggaatag ctattccatg ctggccatca tggagggttg cctgatggca
8161 ggcattcatt tttgcctgtt aatccctggg ctgaaggcaa gagcaatgaa gaaggcccaa
8221 aagaggatct atcatggtct atctaagaat ccagtagttg atggcacacc cactgtggat
8281 attgaagaag ctgaagaaac tccagtactg tatgagaaga agtggcttt ggcactgctg
8341 ggagttgtgg ctgcgctcaa tggaattgtg gtcagaacac ctttctccat ggctgaatca
8401 attgtgctgg ggagtgcctt ggtgggtcct tttattgagg gtaacacgtc tccactttgg
8461 aacgcccta tcgcggttgc gttcgctggt ctaatgcggg gacattatag cagcatgata
8521 ggattggcct acaatttttg gattgcaa aaccccaaaa gaggaggtgg tgagaccatg
8581 accttggcc aggtgtggaa aaagagactg aacatgcttg acaagaagga gtttgcaaaa
8641 tacaagattt cagacattca tgaggtggac cgtaggcaag cacgtaccat tctggacgca
8701 ggcatcacca cgttggagt cagcgtgtca agaggaacat ccaagctgaa gtggctgaca
8761 gacagagggt actttaagcc agaaggtagg gttgtggatc tcgggtgtgg ccgtggaggt
8821 tggtcatact tggctgctgc agcaagagaa accctggaag tgaaagctta cactctaggt
8881 gtgtcagggc atgagcgacc aattcaaatc caaagcctgg atggaatgt tatcaagttt
8941 aaggacagag ttgatgtgca cagacttcca atcgcccaat gtgacacagt gatgtgcgac
9001 attggagagt cttccagctc ttgggaacag gagcgagaga gaaccctgag ggtaattgac
9061 ctgatggaga actgggtggc caagagcaga cccaaatact gcttcaaggt tttggctccc
```

```
 9121 tactcctcag aagtgattga gcgtctggaa ctgtttcaaa gaagatttgg tggcgggata
 9181 atcagggttc cactctcacg caactcaacc catgagatgt actacactag tgaggtcacc
 9241 aataacattg tgcacatggt gaactgcgtc tcaagattgc tgctccggag aatgaccaac
 9301 cccagtggaa tagccatctt agagccagat gtggttttc caacaggaac acgcaatgtc
 9361 aagggggact tgggccctt ggacatggag aagatcaaga tgcgtgtatc caagttaaaa
 9421 aaggagaact tggacacatg gtggcatgat gaaaatcatc catacaggac ctggcattac
 9481 cttggaagct acgttgctaa acagagtggc agcgcagcca ctatggtcaa tggaatagtc
 9541 aagctactga gcatgccatg ggataggatt gaggatgtta ctgccttggc catgacagac
 9601 acaacaccat atggacagca acgtgtgttt aaggaaaagg ttgacactag gctccaccc
 9661 cctcctccag ggactaggaa aatcatgagc attaccaaca catggctctt tgatttcctt
 9721 ggccgaagca aacaacctag actgtgcacc aaagcagagt ttatagcaaa agtcagatca
 9781 cacgctgcca taggcaacat gttggaggag caggaaggct ggaaaaatgc agctgaggca
 9841 gtgaatgatc caagattttg ggaattggtt agtgaagaga gggagctaca cttacaagga
 9901 aaatgctcca catgcatcta caacatgatg ggaaaaagag agaagaaacc cgctgaattc
 9961 ggacgtgcca agggaagcag agccatatgg tacatgtggc tcggagctag gttccttgaa
10021 tttgaggccc tgggtttcct caatgaagat cattggttct ccagagacaa ctccaagggt
10081 ggtgttgagg ggatgggctt gcagtaccta ggctatgttg tggaagatgt gtggaagaag
10141 gggaatggaa tcatgtatgc ggatgacaca gctggatggg acactaggat aacagaggct
10201 gatttggagg atgaacaata cctgcttgaa aagatgagtg gcactcacaa gaaactggct
10261 tgggctatta cagagttgac ctacaagaac aaggtcgtca aggtccctag acctggacct
10321 ggaggaaaga ttctgatgga tgtgattgcc aggagggacc aaagaggttc tgggcaggtt
10381 gtcacctatc ccctcaacac tggaacaaat ctcaagacac agttaataag gatggctgaa
10441 ggcgagggca taatcacccc agaggacaca ctccaactca gtcacaagaa tgagaaaaat
10501 ttgaggggaat ggttgtgcac ccatggtgct gaaagacttg gtagaatggc tgttagtggt
10561 gatgattgca ttgttgcgcc aattgatgag aggtttggca acgccctaag tcatctcaat
10621 gccatgtcaa agattagaaa ggacattgat gattgggagc ccagcaagcc ttggatgaaa
10681 tgggaggagg tgccattctg ctcccaccat ttccaccatt tgctactgaa ggatggcaga
10741 agaattattg ttccatgccg aaaccaagat gagctgattg gaagggccg agtgtcacca
10801 ggaaatggat ggatgatcaa agaaactgca tgccacagca gtcctatgg tcagatgtgg
10861 ctcctcatgt atttccatag gagggatctg agattgatgg ctaacgcaat atcatcatgc
10921 gttcctatca attgggtgcc aactggaaga actacatggt cacttcacgc tggaggagag
10981 tggatgacct ccgaggacat gctggaagtg tggaacagag tttggattt ggacaatcct
11041 catatgagtg acaagtcagt aatcctagag tggagagatg ttccatatct ggcaaagagt
11101 gatgatatca ggtgtggatc attgataggg acatcacaga gagcctgctg ggcagctaac
11161 atccgttctg tggttgagaa aatcaggcat ttggtgggag atgagaagta caaagactac
11221 ctgcactcca tggacagata tgccctggaa cactccgaaa ttggctgctt gatataaatt
11281 aaagcactcc attaaaccaa ccaaacactc cttcatcaaa caacactcca tatttaaagt
11341 gtcaggccgg gaaaccgcca tggctaagct ctgaggccat gcagtctggg agagcagcac
11401 attcttgccc acagttgtgc ttaattacat ttttgggagc ctccctttgt catgcgatgc
11461 atggtggcaa agcgacgagg actagtggtt agaggagacc ctccctgggc tatgcatcaa
11521 gtcggaccgt ttctacggga agctgtaaac cgtactgtcc gtgacagcat tccgaaaggt
11581 tgggcgaagc tgtaagcctg taaaactttg gagcctccgc tctgcgaccc gtgtaagcag
11641 agtcgatggg gactagtggt tagaggagac cctccacagc aaacaacaca cacggatcac
11701 attgacacca gggatagacc ggagattctt cttgcctctc gacagcttta ggcaccgatt
11761 gccaaactac gaagctgtcg agaaacgaca agaatct
```

FIG. 43 cont.

SEQ ID NO:35    CPEC BinJV vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag cacctttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tatattttgc gtgtgcgttt caaaacacag attgtattga aagtacgtaa gagtataaca
1021 cgttggaata aagttttgga tcaagaggaa aatcatggtt acaaaactca ggaggcccgt
1081 taaacgggcc gtcgatatga tgaggcgcgc ggtaccccgc gccgcaggac cccggcgggt
1141 cctaactagg gtatcaaata ccgtgaagcg taacgcaggc gctcttagag ctcttctggc
1201 ttatctgctg taccagacat tctctgggcg gaaagttggt agtggtgctc ggagcgccct
1261 taagcgcttc aacaaaaatg acattgtgaa aatgttgctg gcgttcagac ggacattgac
1321 aaacatcatc acaaccatgc agcgtcgtgt gaaaggaaag aaacgtcgtg gcgttcaaga
1381 tgtgccgcta ttggtcttgc tgctcgttgg agcaggagcg atggctgcca ctttacgcac
1441 cgttggagac ttgacatggc taaatgtgtc aaccactgat gttggaaagt ggatacgtgt
1501 ggagaatagg cacggcaaag gagagtgttt cgtcacggcc actgacgttg aacatggtg
1561 ctcagactct gtgggatatg aatgtcctca aattgcaccg gcgtatgacc ctgaagactt
1621 ggattgctac tgccgaaaca cctcaaccta cgttacttat ggaaggtgta aaatgggcg
1681 cagtggacga tctcgcagca agagagcaat cacgatagcc ccgcacggcg aagcaggatt
1741 gcgtgttgga agcaccaagc attggacttc tagagcaact ccacaacggt atctaatgcg
1801 cgttgagaaa tgggtgctgc ggcatcctct acctgctctc gtgttggtgg tactgggatg
1861 gatgatgggt cgttctcacg gccagagggc catgtatata gtgctgatgc tgcttgtggc
1921 tccgtcatat ggtaaccaat gcctggatgt gcagtcacgt gatttcgtgc aaggggttag
1981 tggtggcacc tgggtagatg ttgttttgga tcatgacaat tgcataacca ttgttgctga
2041 cgggaaacca tcttttgata ttcgtttgtc gaaaatgagc atgtctaaat tcgcagagta
2101 caaacggtat tgcctccagg ccacgatgag tgatgtcact agcatagtgg cgtgtccagg
2161 ggctggggat gctcataatg acaagagcaa aaaccacgag tacatttgca aagctgttaa
2221 caatgaccgc ggatggggca atgggtgtgt ccttttggc aaaggatcaa tggaaacttg
2281 tggtaagttt gaatgtaaga agaaaatggc tggcaagtta gtggcacgtg agaacgtgga
2341 atcagtggtc actgtgcatg tacatggtgc ctccgcaact gacacaaaag gagttgacac
2401 cgcctctaca gccaaagcga ctatcacgcc aaaagcttct gtggctactc taaatttaaa
2461 cgactttggt agcctggagg tggattgttc aactgatgtt ggcatggact tggagagat
2521 tgtggtggcc gacatgtcag gaaagtggtg gatcgtgaac aaggattggt tcaatgaact
2581 tgctttgccg tggtccacgg ctagcaccac tgctgaagtt tggcaggcac gagacagact
2641 tgttgagttt ggatggccac atgcggccaa gcagaacatc tatgacattg ggaccaaga
2701 aggagctgtg acggctgcca tagcccaggc acccatggcg aaatgggagt ctgacaaggt
2761 cgagctaatc tctgggattc tcaagtgcaa ggtgaaactt ggcaacctaa agctgcgtgg
2821 ggtgacctat agcatgtgtg cccagacatt caccacggaa acaaggccgg ccgacaccgg
2881 acatggcact gtggctttca ggtgaaata cgtcggaaca gacgtgcctt gccgggtccc
2941 actccacatc atagacagtg acggcggagt ggccgctgga cgagtgataa cggcacaccc
```

FIG. 44

```
3001 cttcgtcatg aagcagaatg attacattat tctggaagtt gaaccaccct tcggtgacag
3061 caaaattgag attggaacag gaacaacaaa actcgttgaa gcatggcatc gaaaaggtag
3121 ctcgatagga aatgccttta cggccactta caagggcatc acaaaattga cagtgcttgg
3181 agaacatgcc tgggattta attcactagg tgggtttgga gcaagccttg ggaaggcggt
3241 ccatacactg tttggaggtg tattccgggt gatgttcgga ggcatgggat ggttaaccaa
3301 gatctttgtg ggtgctgtcc tagtctggct aggattagga gctcatgaca agacgatcgc
3361 caccaccatg atcctggtag gatccatact gatgtacatg gcagtgaccg tgggtgccct
3421 atcggaaata ggatgcagtc tggacattag ccgaaaagaa atgaagtgtg gggacggagt
3481 cttcatcttc agagaggcag gcatgtggaa ggatgggtat gcgttccacc ttccgaacc
3541 caaatctctg gccgcgtcag ttctcaagag ttggcagtct ggagtgtgcg gcgtgcgctc
3601 cacgaacaga atggaacatg ccatgtggaa acagattgaa aatgaattga acggcattct
3661 agaagagaat gaggcgcaac tcagcgtggt tgtgcgagag tctaacggga ccttcccgag
3721 aggagagcgc cgcatgcacg tggccgaacc tctgcgctat ggatggaaga cctggggaaa
3781 gaccgcaatt tcgacggtgc cgctcgctaa agaaacgttt gtggtagatg gcaatgatga
3841 aggagaatgt ccctctcaaa tgcgtgcttg gaattcctcc caagttgaag agttcggaac
3901 tgggctggtg aaaaccaaag tgttcttgga catatccact gctctcaccg cccaatgtga
3961 caccaaaatg ctgggcgctg ccataaaggg gaataggtct gttcatggag atccaggtct
4021 ctggatggtc tcagctgaaa tcgatgggac atggcagata atagagctca cattggcaga
4081 gagcaggcgt tgcacatggc cagactctca caccgtgtgg ggtaggaatg tccaggagag
4141 tgagttgata ctgccaccgt ctttcggagg accgatgacc aacatgaaca agcgtaaagg
4201 ctacgcgacc caagtgggag gaccatggaa ccatgttcca ctacgagtag tttttgaaga
4261 gtgtccggga accactgtat ctgttgaacc aaactgcacc aggagatcgg attcagtgcg
4321 atccacaact gatagcggca agattataac cgactggtgt tgtcgttcct gtacaatgcc
4381 tcccctaacg taccgaaccc ccgatggatg ctggtatgca atggaaatca ggcccaagaa
4441 tgttaaagag gagagtctga tccgttcgca tgtggcggca ggtgtgttta aaggcattga
4501 cgacgtgtca ctggggctgt tagtaatgat aatttttcctg caggaaggtt tgagaagaaa
4561 gttaactgca acgtatatca tgtgggctgc tcttgtggtc ctcattgcag gaatcctagg
4621 ggaactcaca gtgagggatg tgctcaggta tctcatccta gtcggcactg cattcgctga
4681 gagtaataat ggaggagatt taatacatct ggccctagtg gcggtcttca agattaggcc
4741 ggcattctta tttggattct tgttcaggag tcagtggtcc cccagagaag gtgtgttgct
4801 ggcatctgga gcgctgatgc tgcagattgc aagtgagtgc ttgcacgcat cggcgattat
4861 gcaggttgtc gattccttga gcatggggtg gttgatgatc agagccattg ctgtacctgg
4921 tatgacctca aaagccatgc cactgctgtg tgcctgcatt cctgcagtta cgagcctact
4981 ggcccactca accagagccg gtataatcac catggccggc atgtcgctta ttgcaggaag
5041 taagggatca tcagttaaaa aacacagtcc atacatgctt gccctcgtgg tggcaggcct
5101 cggagcccgt cccataggaa tgttggcgat ggaagccttc tctcacctga agggccggag
5161 atcatggccg gctggtgaga tgatgtcagc cgttgggctg acatgtgcgc tagtgggagc
5221 tatcagtggc gcatcatctc aggacttcgc cggacctcta gcagcagcgg ctctaattat
5281 tattgcatat gccattagtg gacgctcagc tgatgtatac cttgagaaag cggtgagat
5341 atcctggagt gaggacgcta aaatatccgg atcaagcccg cgcattgatg tgtgcgttac
5401 cgaaaatgga gatttcaaat tgcgtcatga gagtgaagca acctggacc ggaattgtgt
5461 cttggctgct tgcttagtcg tagccggagt gcacccactg gggattccag tagcagggtt
5521 gatgtggttt ggatatgtga aatcaaacaa gcgggggact gtgttgtggg acattccctc
5581 accacaggca acatcagctc caacggtgga agatggatgc taccgcgtta tgtcacgtag
5641 actgcttggc agcactcagc ttggtgttgg gatcatgcta gactctacat ttcacacaat
5701 gtggcacata acccgaggag catctattgt tagtggtgaa gggcgtcttg acccatattg
5761 ggctgacgtt aaggaagacc tggtctgtta cggagggcca tggaaaatcc gcaacacatg
5821 ggatggactc tcagaagttc agctgatagc ggtggccca aaagagaatc ccgtgaacgt
5881 ccaaacaatg ccaggaaagt tcattgtggc gaatggaggt gagataggag ccgttgtgct
5941 cgactatcct cctggaactt ctggttcacc catcgtggat cagcagggta atgtcatagg
6001 actgtatggc aacggggtta tgatcaatga ccaaacgtat gcgagtgcca ttgcgcaagc
```

FIG. 44 cont.

6061 tccagctgaa gttgcgcgca ccccaacctg gttcactgat gatatgttgc gaaagggaca
6121 attgcatgtg ctagacttgc accctggagc gggaaaaacc cgcaaggtcc tgcctgagat
6181 tctcaaagca gcggtggaga aacggctacg cacgttggtc ctggccccaa ccagagttgt
6241 ggcaaaggaa atgcatgaag cattgaccgg gctgccggta cgctaccaga catcagcagt
6301 ggcaccaaat ggttctggag gagaattgat tgatgtcatg tgccatgcaa catacacaca
6361 ccgccagctg acaccgggac ggggggtcaa ctaccagtta tacatagtgg atgaggcaca
6421 ttttacagat cccgcttcca tcgcagctcg cggcatcatt gcgactaggg tgcgattggg
6481 acatgccgca gcaatcttca tgacggccac acccccggga atgtcaaacc cattcccgga
6541 gtctaatgct cacattgaag acgaagagcg ggaggtaccc accaaagctt ggaacgctgg
6601 atatgagtgg ataacagact atgggggaaa aaccgtgtgg ttcgtgcctt ccatccggat
6661 ggcgaacacc atagctgcat gcttggtacg agcaggcaag acagtcattg tactgcacag
6721 tggctctttc aatgaagaat atcaaaaaac caagtctggc aattgggatt tcgttgtgac
6781 gaccgacatc tcagaaatgg gggccaattt caaagcctct agggtcatag actctagact
6841 gtccataaaa ccgatgtttt cctacgctcc cagtgagcga gtggttattg gctcacctag
6901 agcggttct ccagccagcg cagcacagcg ccgagggaga gtcgggagag accctcgtca
6961 actgggcgac cagtatatct atggtggacc agtaggagaa gactcggccg agttcgttca
7021 ttggaaggaa gcaaggatcc tcatggataa tgtaactgtc cctgggggct tgtatccaca
7081 attctacgaa ccagagggtg gaatgtgtga cgccatggat ggagctcacc gactgaccga
7141 tgctaagaga gaagtgttcc gagacctcat gaagaaaggg gaacttcctg tatggttagc
7201 ataccaggtg gcccaggctg ggcatgcgta cactgacaga acttggtgct atgggggcc
7261 ggcggatcat caagtgtatg atgattgcgg ccaaaccgtg gattacaggt cccttaatgg
7321 agagaggcgt atgctacgtc ccaagtggct tgatcagcgc acctacaacg acaaaacatc
7381 cttaaggctc ttcacggaat ttgcagaggg acgccgccga tattcggaac taatggacgt
7441 gtttggaaga atgccccaac acatgttgga caggaccatc ttggctgcag acacgtttaa
7501 agatgtcctg acagcaacac cgggatctcg tgtgcaccgt ttagcactgg acaatttacc
7561 cgaagctaca gaaactatga tggtagtggg aatcctgagt gtctcgaccc taggcgttat
7621 gctatttctg atgtcaccca agggcatgac ccggatgacc tgcggacttg tggtgatcat
7681 cctggcgacg tattttctat gggtgtcagg aatggccggc taccagatag cagcaatgca
7741 actcatcgcg ttcattctgt ttgtggtctt ggtgccagag ccagggtcac agagatcagt
7801 gcaagacaac accatagcga taattctcat agtcatcctg tcgttggctg ccatcatagc
7861 cgccaatgaa gcaggattgc tagagaagac caaaaaggat ttcgcgtgga gagggagag
7921 tcatgtgctg gtgactccga gtccgtggaa cctggatttc tcaatggatt tgaggccagc
7981 caccagctgg tcattgtatg tggtgatggc caccatgtta gggccagtac tggaacacgc
8041 cattgtcacc aattatgcta gcgtctcact tactgccatc acaaaccagg caggaatact
8101 gctgtcaatg gataagggca ctcctttctg gaatcttgac tggagtgttg tcctgttgtg
8161 cgtgggcagc tggtcgggga tcaatggcac tacactaatg gttgcttcca caatgacagt
8221 tttgcatttt gccatgatac tacctggcat tcgtgccaaa gcggcgagag aagcacagaa
8281 tcgaacagca gctggggtgt caaagaaccc tcttattgat gggttaaaca ccataaacat
8341 ccagccgttg cggaaatgg accccatgta cgaaaggaaa atggggctat ggatgctaat
8401 cgctgttgcc ggagccgcgg tggtttttga caagagaatg ctccattaca ccgagttcgg
8461 agtattgggt tcagctgctg tgagtcctct cattgaagga tacgcgtctg ctgtttggaa
8521 cacttccgta gcagccagtg tgtgcaacct aatgcgaggc cattacatgg cgggaatccc
8581 aatggcatac tctctgatca gaaatctatc catgaaagga gttcctagga ggattaca
8641 ggccacccat acccttggta tggtttggaa acacaaatta acgccatgg acaaggcggc
8701 ctttaacgca taccggaagg atggagtgac agaagtggat agggagccag cacgtgaagc
8761 tatgaagaaa ggagatttgg tgagcggatg ggcggtctct cgagggtcag ccaagctgcg
8821 atggatgcac gagcgtggat acattcccct acaaggagtt gtcattgacc tcggatgtgg
8881 aagaggggg tggagttact acgctgctgc acaacgccgg gtgaccgctg tcaaagggct
8941 cacgaaaggc ggaccagggc atgaggagcc aatcaacgtc cagtcatatg gatggaactt
9001 agtgacgttc cgtagtggag tggatgtctt tcacaccgaa gtccagccgg ctgacaccct
9061 gttgtgcgac ataggagagt cttctgctga ccccgctgtc gaaaaagcgc gcacagtaca

FIG. 44 cont.

9121 agtgttggtg aactttgaaa gatggattag agagtcgcgg tgtgagcatt tttgttgcaa
9181 ggtgcttggt ccctactctc ccgaagtgat ggagcgctta gatcgtttaa caaagacata
9241 tggaggagcg gtaattcgca acccactatc caggaactcc acgcatgaga tgtactgggt
9301 gtcaggagct aagggtaatc cagtcaatgc tataacagcc acctcacgtg tgctaatcga
9361 acgcatgtac agaagacttg gcaagagtta ctgggaagaa gatgtgaatc ttggtactgg
9421 gacccgtgca gtttcatgtg ccgcggagaa gccagatcta gcaaaaatcg gaaggcgcat
9481 tgagttgctg aagaaggagt ataaagcatc atggttcgag gatccagagc atccctacaa
9541 gacatggaca taccatggtt cctacgaaac caagaccaca ggcagctcgt ctagtatgat
9601 taatggcgtt gtcaaggaga tcactcaccc ttgggatacc aacccaaggg ttacaaccgt
9661 ctgtatgacc gacaccactc cttttggaca gcagagagta ttcaaggaaa aggtagatac
9721 caaggcacgt gagccatctc aagggacgcg ggagatcatg agaatagtga gcaagtggct
9781 cacactatat attggtcgga gcaagcgccc taggctgtgc acagcggatg aattcatagc
9841 caaagttaat gctgatgccg ctctcggcac gatgttcgac tcgcagggaa actgggcgaa
9901 cgccaaagaa gctgtgcgcg acccacggtt ttggcagttg gtggccaaag agagggaact
9961 tcacctgcgt ggacagtgtg ccacgtgtgt ttacaacatg atggggaagc gagagaaaaa
10021 gctgacagag tttgggaagt cgaaggggag ccgagcaatt tggtttatgt ggctaggagc
10081 taggttcttg gagtttgaaa gtttaggctt cctaaacgag gatcattggt tgtcacgtga
10141 aaactcagga ggtggagttg agggcattgg attgcaatac cttgggtatg tgttgaaaga
10201 aatggcacta attcccgggg gcaagatgta cgccgatgac accgctgggt gggacaccag
10261 aattactaac gctgaccttg aggatgagat ggacatattg ggacttatgg acccgcatca
10321 caaaaaactg gcaaaaaatc tgatggagtt ggcgtacaac aacaaggtgg tcagagtgat
10381 gcgccctggt aaaggggaa aaacactaat ggacatcatt agccgcaagg accagcgggg
10441 aagtggacaa gtggtcacct acccactcaa cacgtggacg aatctcaagg tccaattgat
10501 ccgtatggca gagtcagagg gagtgttgga ccccaaggag atcgatggaa tcactgtcac
10561 gactcggaat aacctggaaa aatggctcac tagccaaggg gctgagcgtc taaagcgcat
10621 tgcagctagc ggtgacgacg ttgtggtaaa accagtggat gagagattcg ccaatgctct
10681 cacctatcta aacgacatgg ccaaaattag gaaggacatc agtgagtgga aaccatccgc
10741 ggggtggttc cactgggaag aagtgccatt ctgctcacac cattttcacc agttggtcct
10801 caaggatggg cgcaccttag tggtcccatg ccgtgaccag gatgaactaa ttggaagggc
10861 aagagtgtca cctggtgctg gatggactat cagagaaact gcaggtcaa gcaaggccta
10921 tgcccagatg tggcttctaa tgcacttcca ccggagggac ctcagaatgg caggtttcgc
10981 catttgtagt gctgtcccca gtgattgggt gcccacggga aggacatcgt ggtcactgca
11041 cgctaaaggg gagtggatga ccactgaaga catgttagca gtttggaaca gagtgtggat
11101 tgaagacaat ccccacatgt ctaacaagac tttagtggga tcatggcaag acatcccgta
11161 ccagaggaaa tccctggaca tccactgtgg ctcaatgata gggcagcggt ctaggtcaac
11221 atgggctgct aacatacgaa ttagcattgg acacgtgcgc cgattgattg gaaccacgga
11281 aaagtacttg gattacatgc aggagcagga gcggttcaag attgctgaac caacccgtct
11341 gggcaatgtg atctaaggat ctacgaacga gaataagtag aagaacggaa cgacagagtc
11401 aggcctcaaa tgagccagca ttaatgagag taagtgctgc tgcctgtgcc tctccttaac
11461 acgtggtagc gccactcgtg tttcgttacc taatagcgct agagtcagac ccaagtaggc
11521 cagggctatg gttgtaagcc ctgctgtctg tggcagccat ccagtggtaa tgcgtcgcac
11581 cactaaggat taatagacgt atattgggag ggactggtga ggagcagcaa gctcgagctg
11641 catcacccac tggtactatc ggttagagga aacccctcc aaaatgtaga gcatcatatc
11701 gacacctggg aaagaccgga gatacctctt gcttcacagc actcaatcca caaggcacag
11761 atcgccgaat aattgtggat tggggattga gaaacatcaa gtatct

FIG. 44 cont.

SEQ ID NO:36    CPEC PCV vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata tggggaagg ccatccagcc tcgcgtcggc
 421 gcttaaggat catgatgata aacaatgtat ggtgctaatg ttgcttcaac aacaattctg
 481 ttgaactgtg ttttcatgtt tgccaacaag cacctttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 ttttaaaaaa cttttgcgtt agtaaaacca cggagttttg gtttgctgag aatagtgcga
1021 gggttgtttt aattatttcg gagattttgg ttcgtgatga atcaggagag aggaatactc
1081 aggggtatgg ggaggttccc ccccccccct gtgaagaagg ggaacaagaa ttctgttgcc
1141 gtggccaggg tgccaccgca gcaaggagga aaagcgagag agaaaaaccg tgagaggatt
1201 aaagcgccag gagcgcgaca tggagttgcc ggaaagatga aaagtctaat gggagaattg
1261 ggctttggat ggattgattt actacgcgtt gatttggtgg aaggaattat gatgatggtt
1321 tttgttatac agcgggcttt cgcccaagtg caccggagaa ttagaggatt atcaagacgc
1381 gtcagggcat tggagaagaa gcgtgacggt cgagcggcta tgttcatttg gactatattg
1441 gcaatgttat tcggagttat gggagttgtg gtgattgaca tgcgtgtgac gtatgacgga
1501 caagtgcaga tttatcgcga cggagagaat atgacagatc gagttgcgct ctttaagctg
1561 ccaactgacg gttgttcagt tggggttgcca gtttcaaaga tgtgccacaa agtggataaa
1621 aacatgaaag aaggattagc ggacacggat tgcggatcaa catgggcaga gtttaggttg
1681 agataccaac gatgccaagt gaagacacga gcgaagcgag ttgcgccaga tggcccaaag
1741 caagactttt tggcagaagt ggaaatagtg gctttttaaag ccatccggga aaacaaaagt
1801 gtgttgcttg tggtcgtgtt gtgcgtggcc atcgcgaaaa gatggccatt gtgggtgttg
1861 atactactgt cgattggaac atggacaacg gttcgaggag aatacatgga accgttgtat
1921 gtattgaaag cagaccagat gacaatgatt cagacaacgt tgaggccaga agagggatac
1981 gtgacagcga cggcaaatgg gttatttgag atgaaaacag gaagagcgtt catctatgga
2041 agccaagtgg tgaaaacact ggtaactgac tgtgaagtta acgcgacata ttcaactgat
2101 atatgcccag gcggatcgca gctgtcaatg caggacattc aagcggaagg aagagcatgt
2161 gcctcggagc cgtataatcg aggctgggc actgggtgtt ttaagtgggg agttggattc
2221 gtagcaacat gcgcggaggt tgattgcacc actagtgtga aagttagctc agtggctcgc
2281 tcgacaatta agatgaatgt gacggcaaca taccactcag tgaaaagtgt gcagagtgtg
2341 ataagtgatg tacctgtgac attccaattt gggcagctgg gcattgcctc tatgacatgt
2401 cgtttggagt ccgaccgaat tgcccaatca tactatcacg tggaaggaaa caagaaggag
2461 ggactattca tgaaggaaca gattgatgga tggaacggag ccacgttggc tgctggaaag
2521 atagccaaca cagagaaaat tgttatttgg ggagatgtga aaccaaatga aattttggtt
2581 aaggcggttt cagaacccca actggaatgg actaatgcta tagctacaca tgatggcttc
2641 cgagatgtgg gatttgtttg ccagataatg cttgacaagc ttgttaccgg agtgtttaaa
2701 gattgtaaga cccctaaaac gtccacattc acacaaagcg gatttggctt tgacggaatt
2761 ataactacca cgttagctgt cgcccaaact gaagcctgct cgatcagcat ctcctgtaaa
2821 ggatgcacgc ttttggcaac aaaagcagtg ttttccgctg gggatattga gtcgaagaca
2881 tgggtgcgat gcggaaacga gagtgaaaca gcgatcgttg gaggacaaga agttgccgtt
2941 gcgtgcgcca caaatcccat cacgcaggga tggagattgg tgaagcatgc tactcaacgt
```

FIG. 45

```
3001 taccggaagt ttggaatgcc aggagtaggt ggagtattcc acgatttagt gggaacatta
3061 aatccatgga gtttcttctc taccacgact ctggttttca tggcggtagt ccttttcatc
3121 gtggacaaaa gaatcttgat tttggggata gcttgttata tgtttattt tgtgcgagcc
3181 gacttcggat gtggatttga cccagatagg aaggtagcac agtgtggttc tggctcattc
3241 gtgtggaagt cactggcccg ttggccaatg gctgatcacg ctattgagtt tgaagatagc
3301 aaagtgatgg tgacttactt gactgaccta ttgatgagaa agaacaaagt ctgcatagtg
3361 tgtgaagatg tattgcagtg tgccgcagcg cgtggagttg tcgagcagat aacgtcgatc
3421 aatggaatcc caatccatca caacatgtcg ctgtcgcatg gccgatattt cccacgtgta
3481 gtgaagaaag tacacaatgt taaggtggga aaagccatgt tgcgccttgc aatggccaca
3541 tatgcgggag cgatgcctga gagtggattg ggtgttttga agacggggta tttttcacgc
3601 ggagaagtgc aggaaacgtg ggatgataaa gttctaagag tcctaaccag cgccataaat
3661 gcagaggaag tgtgccagac ggctgtcacg ttccagtatg agttcgttcg atataaccgg
3721 aaagtctttg gatctaacat cgtgttgcga ccttcagcct ttacgagcaa agcttgccca
3781 acatatttag ctggggctgt ggtcaaaaac gacatagcaa cgtttacgga cggaatgatg
3841 tggatgcgga gccggaaagt caatgaaacg tgggaactgt ttgagttgga aacaacccaa
3901 agccaccaat gcatttggcc atacgcgtac acaatagacc tagcaacacc cacggacaag
3961 aggcttttca tgccgccaca atacggagga ccaatttcgt ttgcgaacca cgtgcctgga
4021 ttccaggtgc aagaggactt tccctggcag aaggcgaata tattaatgcg ccagggaccg
4081 gttccgggaa cgaccgtagt ccaggatcca cactgtgatg accggagcgc ggcagtgcca
4141 gttgaaccaa ctatgcaagc ttggtgctgc aagacctgtt ttgatagagg agtgaagcct
4201 ttccattttg tggttgacgg gaaattttc tatccaatgg aagtgcggcc aatgaaactg
4261 gaacaagacg ctgtggtgat tgagactgat gatggagagt tcgagaggag tgagcatgag
4321 agcttgtttg aaggcaaagc aaagtggaca tcaccgttac caatgggaga aacagccaag
4381 attcaaaatt ttttcgtgac cagcccgcca aagccggaat caagcctgct tttggtgggc
4441 gttctgattc atatgttaac aacgcgaacc cgccatcggt gggcaactcg ttgtgctgga
4501 acttggctca tcttttggt cttggacat ccggttgtgt cttcggtgca gtcttgggcg
4561 tggctcttta tgtcagctgc cttagcaagt gtccctggtg gttcttcact ggtgatccac
4621 ttctggattg ggttgcagat atcgtcagcg cacctctttt acctggggttg gttaatgagg
4681 aaacgcctgt tgattacaga gatgtcgcga gtggcacatc tgattgccca gttgtgcagc
4741 ttcgagacat atgcgtgggc accgatcctc aaagtactgg atcacttgct gtttccactc
4801 tacactctgt cagtattcgt cgttcaccag cagtttcagg tattccacga cttgtggcta
4861 cagagcgccg tggtgatggc acacctgttg caacaccctc tcagtggttt aataaccttg
4921 agtttaagcg tcggcttgat tcagctaata gcaccaatga aaagatggtt ttgctcacca
4981 gttatatggg gagatggctt acgcgcgccg agaccacact ggacagcctt aacgtatttc
5041 atcgtgctgt atttggcagc cgctgggatg gagacagtgg gtctgcacac gtccgggatg
5101 acagtgatgc tgggcgggat gcttctgtgg gttgtcctac agttgatgcc cccgacagcc
5161 ttggaacttg tgcgcctacc gggacaaagt ctgccagacg gatgtgaaga agaagcgtca
5221 acatctctac cagaaggaat gagtgggcat tacgcccccg atggagttga actcgtgaac
5281 tacacagatg cagggactgt ctccgcaaac cttgtggtat ttgttgggtg tgctggaatt
5341 atgactatga acatatacgt tgggttggtt atcacggcct tggcctgggt aacggacgcc
5401 ccgatgtgga ttccaagatt gattgatggt gctatgtccc agcgggcaaa ttcggagcta
5461 ttgctgccat ccccacctct tgagatacac aagacggaag actcgtttgg ttacatcccg
5521 gacggaacat atcacgtgtt ggctagcagc tggatgagca agaaaccagt tggtgttgga
5581 gtggtgaagg agggcgtgtt tcacacgtta caccacgtca ccaaaggagc taatgtgaca
5641 tgggcaggac gtgaggttag gatgcactct ggagatgtta ggcgggatat tgctgcctat
5701 ggcgggccct ggaacatcag cgggagtctt gaagatgtcg tagtagtgaa ggccgtgaac
5761 aaggatggaa ccgtgacatg ctgccgatt acaacagcta gttggacat tgaaggaact
5821 acagtgatgg ctgttgagcg agattttggt ttcggctctt cggggtcccc catatacgct
5881 cctgatggac ggttgattgg cttgtatgga tacgggtttt actatggaac gtacttctca
5941 atagtttcaa caggagaagg agtgaggca ccaccggaag aggttgaagt ctcaacacgt
6001 gagtttgtgg actggcaccc tggaagagga aaaacgcgca cgatactcgt tgagcaggcc
```

FIG. 45 cont.

6061 ctgaagcata tagctgatgg aaagaggttg ctaattttga caccaacgcg ggtcgtaaag
6121 gatgaagtgc agcgagcgat aaaggaagcc gccccgcagg cggttatcgg atcgaactta
6181 agcattttc ggaagaacgc cgttaccttg gcatgccacg cgaccttcac gcagtatgtg
6241 atggagaagg ggatagaaag tgtgaagttt tcgaccatca ttatggacga gtgccacttt
6301 ctggacccga tgtccatcgc gtgccgcggg ataatggatt tccacaacag ccgtggaacg
6361 aaggtcatct tcatgagtgc gacgccccca ggacgagcag gaaacgctgg gtccaacttt
6421 acaatagaag acagagccat caagttcccc aaggagttga ccgcatcgtg gatcaaagac
6481 aagtcaatag gcaagaccat cgtttttgtg ccaacaatta cgcaagctgt gaggctggct
6541 aaagagttgg gaggggtggc cttgacccga gatacgttca atgatgccat ggggaaggcc
6601 cggagtccgg aaacaatgtt tataatctca acagacatca gcgagatggg agccaatctc
6661 ggagtgacta ctgttatcga cacaagaact gttataaaac cattagtgtc tgacaaagga
6721 gtttcacttg aaagggttgg tgtgacccca gcttcaatca tccagcgcag gggccgagta
6781 ggtcggcggg agcccggagt atacatttat ccccttgacg tcgaaccaga ggagcagccg
6841 gaaaattggg tgtgttgggt ggaggcgcaa atgatcttag atcaattggg ctgccatccg
6901 atgagagagg agagcgaatt tttccgccca caaggcacgt accggattga cgacgtagag
6961 cagcggaggt ttctggggtt gatcaaggaa aaactgccaa tttggcttgc ttggacttgg
7021 gccagctcac atgcgaacaa acatcagatg ctatttcagg gaaacgcccc caacactgga
7081 cgaacattaa aaataaagac gccatccgga tctcacattt acgcccaaa ggtgacagat
7141 gataggtttg aaaaggagcc agaaattgtg aaagtggcgg ccatcggatt cttcctaaag
7201 cagagatcac tatacttcga cttacctgga ttattgaccg gattgtacac ggtgttgaca
7261 acggctgggc tcgatgccct tggaaattcg ttcaaacgct ctgtggacac ccttcacgac
7321 atcggaaatg cggtggaagg agagttttct gctatacaaa tgggacggat tttacagatg
7381 tggtctgcgt tgtttatcgg ggtgactttg ggagttgtgc tgatgggagc cggatttgtt
7441 gtggtgaagg cttttagagg attgtttgga acccgccaac aacacacaac tgtgtgcgtg
7501 tcggagggcg gaagtttcca aaaagttgcc acggttctaa tgagcgttgg accattgtgc
7561 gccgttttg gtggcattcc ctctatattc gtcttcattg tgaccgttgc cctgttgatt
7621 gtgctgtgtg tgggcggagg tggctctcaa cgtggtgtgc ttgattcgga tctaatacgc
7681 tgggtcatgg tgttggccat gatgacaatc ggagtgactg cgtgggagtt ggagctatta
7741 ccaaacgtga gaagagatgt tatacagttg actcgatacc tgtttgctag caatcctgcc
7801 gttgttggag ctgtgtttaa cgccgggaat atcggattgg gagtctctct gccagggacc
7861 ctcatgatga gctacgccgc gagcggaacg ctggcccccc ttattggagc gtgggccgaa
7921 ggaaatttct taggaaagct ctttggtagc gaagtgcttc cagctcaggc tataggcgga
7981 tttcaagtga cagctatccc gtggggatct atggtgccgg ttatcgctgg ttgctttcta
8041 gcgacaaaca ctctttcgaa agtgtttggt gctggaatta caactgtgtt tctcatacta
8101 ctctacttcg acaagaaaca tgcattcacg aacaaggctg ttaaggtttt gttggcgcgg
8161 acaaacagaa gggacatgga ggaagaaatc acaacaaggg acgcggagtc gcgggctcgc
8221 caactgtttt atggcctaca actgccgta tcgttgctgt gggttctctc acatcctgtg
8281 ttggaaaact tcgttccatt ctttgctgtg tgcgggtaca cattcctgtc gctcttgagg
8341 ccaaatcatc aactacatgc tgcgttggat tatacattgg tagtcctgct cttgcaggta
8401 gttgaacctg gaacatcat gtacgtcggc ggatgcgttt tgttatggta tgttttaaac
8461 cctaccagat tgggcgtgcg ctcgctggtg aagagtgaca ccggaggttt aggcttccgt
8521 tggaagaaag cgttgaattc acttagtgag aggcagtttg ccatctacaa agtcagaggc
8581 gtgaatgaaa ctgataaagg agcctacgtg tcgcgaggtg gtttaaaaat gaacgagatt
8641 atcaacaagc atgcgtggga acctcgagga gttgtcgttg acctgggatg tggacgagga
8701 ggttggtccc agcgcttggt gatggattac gcgtcgctg aagtaagagg atacacactt
8761 ggaggcaaag aacgtgagaa tccccaaccg ttccaaacga aaggatataa cttggcgaat
8821 ttgaaggctg gagttgacgt ctataaaatg gagccagtga attgtaacac cataatttgc
8881 gacataggtg agagtgaccc gcgtcctgaa gttgaaaaaa ctcgaacgct gaaggttttg
8941 ggaatgctgg agaaatggct ggaagtcaat ccaaacgcct cttttgctg caaagtgcta
9001 tcaccttatc acttggacgt gcttcgaaag ttagagtcgc tgcaacacaa gtataacggg
9061 cggctggttc gactgtctta cagtcggaac tcaacagcag aaatgtatta tgtgtcagga

FIG. 45 cont.

9121 aagagggcaa acgtggtggc aagcgtgtac ttcatgcttg ggtcgctggt aggtaggctg
9181 cggagacatg agccatcaat catcgacccc ccaccggttc tagagatggg aaccagaagc
9241 gatccgcgag caaaggccaa agcgcaagac ttcgagatga tccgaagaag agtggaacga
9301 ctacgaggag aaaatcggaa aacatggttt gtggacaacg aacatccata tgtgtcattt
9361 aactaccatg gatccttcgt gactgatgag gtgacagcgg gcggacaaac aacaaatccc
9421 ttgattagac gcgttatgtg gccatgggac tttctgtctc gggtgacaac ctttatgatg
9481 accgatgttt caacgtatgc ccaacaaaag gtgctgcgtg aaaaagtgga cactgtctct
9541 gaggagcccg acgagcgaat gaaagcaatt aacagactca tcatgacaca cttcgtgaaa
9601 atgttcaagc ggcgcgggct gaaaccgagg gtgttgacac cacaagacta catgaataat
9661 gtccaagcca acgcagccat aggaggatgg agcgaagtaa tggattggca aaacgtgcgc
9721 gatgctttgg cagatcaacg attctgggac atggtagata acgagagggc cttacacttg
9781 cgtggtgact gtgagctttg catctataac acgatgggaa agaaagaaaa gaagccatct
9841 gcctttggca ctgcgaaagg ttcacgcacc atctggtata tgtggctggg tagccgttat
9901 ttagagtacg aggctttagg attcttgaac gaagatcatt gggttgcacg agaaaacttt
9961 ccatgtggag tcggtggcgt cggcgttaac tattttggat attacctgaa ggaaatagcc
10021 gggggaggcc ggtggcttat cgcagacgat gtcgcgggat gggacacgag aataacccaa
10081 ggagatctag atgatgagct gttcatgtta accgagcttg ccccaaccac ataccacaag
10141 aaattgataa ctgcgacaat gacgttggct tataaaaaca tagtggcctt attccctaga
10201 aatcatccga tgtaccgaag tggaactgtt cttgatgtgt tgtctcgaac ggatcagcgt
10261 gggtcgggcc aggtgacaac atacgctttg aacactgtga ctaatggaaa gtgccaggtc
10321 gggagaacat tagaagcgtg tggcttgctg gacgccccgc tcaccacaat cgactcctgg
10381 ctcactgcca acttggaacg agttcttgga gcaatggtcg ttgccggaga tgatgtggta
10441 gtggcgacag acaatgaaga attccacacg agtttgagat acataacagc gacgtcaaag
10501 atccgaaaga acttaggggt gagtgagcca tcgccgagat tcacgagctg ggaagatgtt
10561 gagttttgct cacaccactt ccatccactg acgttacgtg atggccgtgt gctgatcgcc
10621 ccgtgtcgtg accaaaacga aattatcgga agatcaagaa tccagaaagg cggaatagtt
10681 gacatggcct cggctgggtg cttagcgaag gctcacgcgc agatgtgggc cctttacttc
10741 ttccatcggc gagacttacg gattggattc gcggccatca catcaattgt gcctatcaac
10801 tgggtgccga cgggcaggat atcatggtct atccaccaga acgcagagtg gatgacgact
10861 gaggatatgc taacggtttg gaacaacgtg tggattaggg acaatccgtg gatgagagga
10921 aaagaacgag tgacttcatg gacagacata ccgtatttac ccaaaggagt ggacataaag
10981 tgcggaagcc taataggcga ttccgaccgc gcttcctggt caaagacgat tcccctagtt
11041 gtggagaaga cccgaaaaat ccttgagcag gagaggggaa cattgaagtt ctacaatggg
11101 ttatccattc taggacggta tgttcaccac gtcgatcctg tgttcaactg aagtgtgacg
11161 atgtaggccc gcgggagcct tagaattcaa gagcttggga attctagaat cccgtttacc
11221 gcaggagggg gtcatatgga gcaggtggct atgtatagcc tggctaaatg tatggctcct
11281 gggggagtga cgcccctccg gttccagttc ctgggtgaac aggtaaaaac caccacgaag
11341 cgccgcttca acatcgcaag ggggagaaat cccgggtgct gacgccaccc cgacccagt
11401 cccacataag gctgtgacga aagagcctta ccggcacgag gagtgcccac cgcaaggagg
11461 agaaatcctg ggcgttgacg acgccccggc cccagtctct gataggtgac cagaaccatg
11521 tcaccccaaa gtgttgaaag gacactgatc accagaaatg gtgagggcac acagggctta
11581 gcccaaggtg agtgacgaca cctcccgaaa tgtgtaaata gcagggtcag ctctaagcag
11641 caggcttcca ccgttaggaa gcgttgctgt gagcttactt ggctacgtct

FIG. 45 cont.

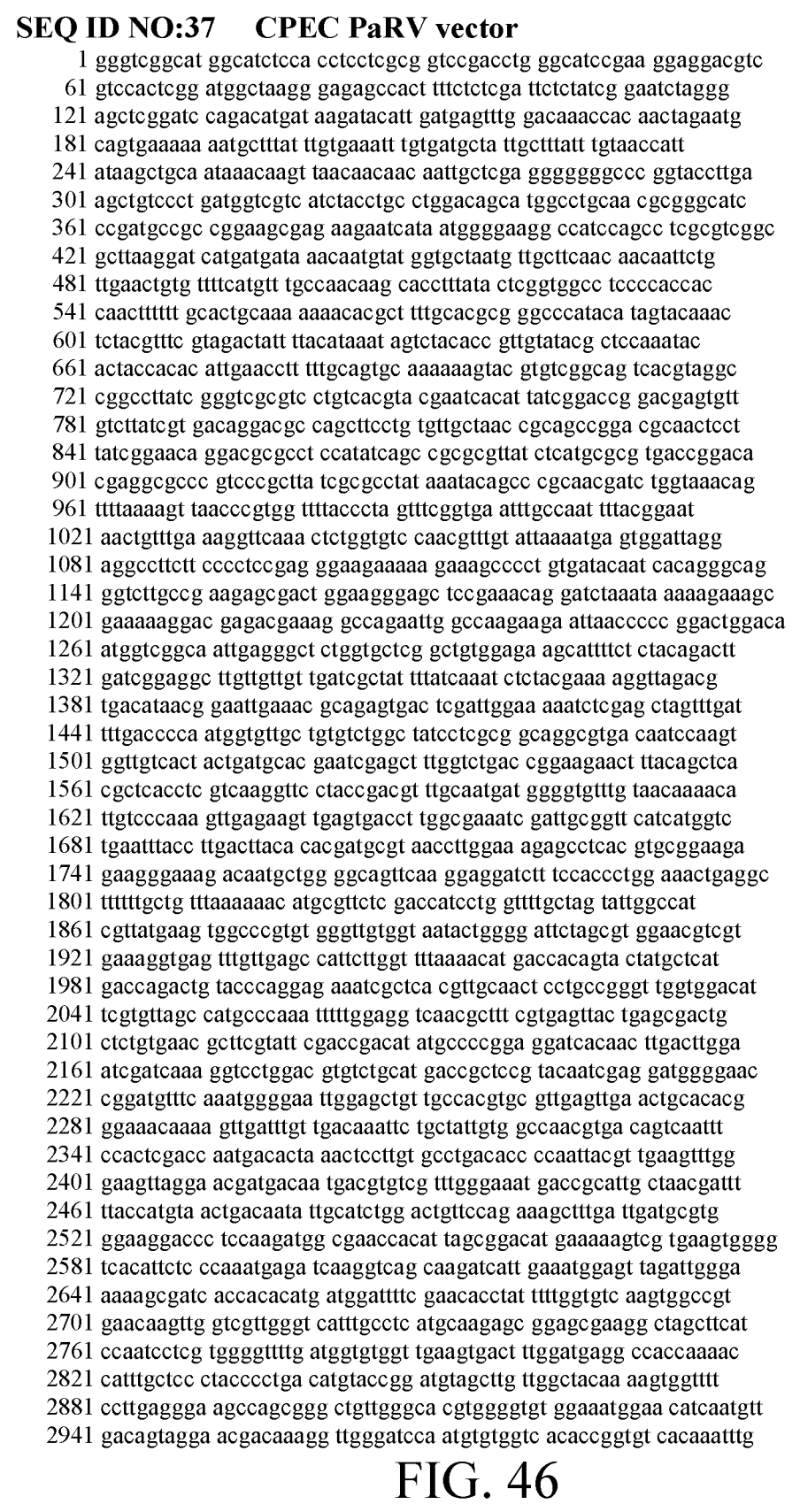

SEQ ID NO:37    CPEC PaRV vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga ggggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata aacaatgtat ggtgctaatg ttgcttcaac aacaattctg
 481 ttgaactgtg ttttcatgtt tgccaacaag cacctttata ctcggtggcc tccccaccac
 541 caacttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 ttttaaaagt taacccgtgg ttttacccta gtttcggtga atttgccaat tttacggaat
1021 aactgtttga aaggttcaaa ctctggtgtc caacgtttgt attaaaatga gtggattagg
1081 aggccttctt ccccctccgag ggaagaaaaa gaaagccccct gtgatacaat cacagggcag
1141 ggtcttgccg aagagcgact ggaagggagc tccgaaacag gatctaaata aaaagaaagc
1201 gaaaaaggac gagacgaaag gccagaattg ccaagaagaa attaaccccc ggactggaca
1261 atggtcggca attgagggct ctggtgctcg gctgtggaga agcattttct ctacagactt
1321 gatcggaggc ttgttgttgt tgatcgctat tttatcaaat ctctacgaaa aggttagacg
1381 tgacataacg gaattgaaac gcagagtgac tcgattggaa aaatctcgag ctagtttgat
1441 tttgacccca atggtgttgc tgtgtctggc tatcctcgcg gcaggcgtga caatccaagt
1501 ggttgtcact actgatgcac gaatcgagct ttggtctgac cggaagaact ttacagctca
1561 cgctcacctc gtcaaggttc ctaccgacgt ttgcaatgat ggggtgtttg taacaaaaca
1621 ttgtcccaaa gttgagaagt tgagtgacct tggcgaaatc gattgcggtt catcatggtc
1681 tgaatttacc ttgacttaca cacgatgcgt aaccttggaa agagcctcac gtgcggaaga
1741 gaagggaaag acaatgctgg ggcagttcaa ggaggatctt tccaccctgg aaactgaggc
1801 tttttgctg tttaaaaaac atgcgttctc gaccatcctg gttttgctag tattggccat
1861 cgttatgaag tggcccgtgt gggttgtggt aatactgggg attctagcgt ggaacgtcgt
1921 gaaaggtgag tttgttgagc cattcttggt tttaaaacat gaccacagta ctatgctcat
1981 gaccagactg tacccaggag aaatcgctca cgttgcaact cctgccgggt tggtggacat
2041 tcgtgttagc catgcccaaa tttttggagg tcaacgcttt cgtgagttac tgagcgactg
2101 ctctgtgaac gcttcgtatt cgaccgacat atgccccgga ggatcacaac ttgacttgga
2161 atcgatcaaa ggtcctggac gtgtctgcat gaccgctccg tacaatcgag gatggggaac
2221 cggatgtttc aaatggggaa ttggagctgt tgccacgtgc gttgagttga actgcacacg
2281 ggaaacaaaa gttgatttgt tgacaaattc tgctattgtg gccaacgtga cagtcaattt
2341 ccactcgacc aatgacacta aactccttgt gcctgacacc ccaattacgt tgaagtttgg
2401 gaagttagga acgatgacaa tgacgtgtcg tttgggaaat gaccgcattg ctaacgattt
2461 ttaccatgta actgacaata ttgcatctgg actgttccag aaagctttga ttgatgcgtg
2521 ggaaggaccc tccaagatgg cgaaccacat tagcggacat gaaaaagtcg tgaagtgggg
2581 tcacattctc ccaaatgaga tcaaggtcag caagatcatt gaaatggagt tagattggga
2641 aaaagcgatc accacacatg atggattttc gaacacctat ttttggtgtc aagtggccgt
2701 gaacaagttg gtcgttgggt catttgcctc atgcaagagc ggagcgaagg ctagcttcat
2761 ccaatcctcg tggggttttg atggtgtggt tgaagtgact ttggatgagg ccaccaaaac
2821 catttgctcc ctacccctga catgtaccgg atgtagcttg ttggctacaa aagtggtttt
2881 ccttgaggga agccagcggg ctgttgggca cgtggggtgt ggaaatggaa catcaatgtt
2941 gacagtagga acgacaaagg ttgggatcca atgtgtggtc acaccggtgt cacaaatttg
```

FIG. 46

3001 gaacttcgtg actcacgctt ccggacgata tgcgaaactt ggttttggag gagttggagg
3061 agctttccat gatctgctag tgaaggttgg attgaccttc acctgggatt catggaagat
3121 catcaccgtg ttgtctggtc tcgtagtggc ttttgccatc tttgatcgga agttggtgat
3181 cctgatcatt atcctctgtg gaatcgctta tacccgagct gacattggat gtggcattga
3241 ttttgacagg aagacctaca cgtgtggaag cggtctattc gtgtggaagg gtttgggaaa
3301 atacccaacg gccgaccatt ctgttgagtt tgcctcatat gattttctat cagcgtacct
3361 ccaggagcag tttaagtctg agaagaaggt ttgtattatt tgtgaagaca ttgtccagtg
3421 tgaggcagct agaaaagcag ccgctgcggt gtataaaaac ctaggccacc cgtttgtcta
3481 cgtgaacacg tcggactcct atggaaaagt atttgccgaa atcccgaaaa gagtccacac
3541 tgttagtgtg ggagtcgacg ttgtggaaat ggccatgatg actagggaga acaaaccggt
3601 tggaccgttt ggtgacttac cgcgtagtat ggtttcgtgg aagagtatcc ctgaaacaga
3661 agagcaccca gtgttgagag tgttgacatc ttcaagtgat taccagaagg tatgtggaaa
3721 agcgattgga ttccagtatg attttgttgg ataccgtcgg accatgtatg gatctaatgt
3781 ccagttaaaa atatcaaaga aggtttcgat tgaatgtccc acatacttgg caggagtcgc
3841 cgtgaaaaat gatagaacgg ttttcactga tggaatgttc tggatgtcat cgaaacgtga
3901 gaatggaaca tacgcgatca ctgagttaga gatggagcag tctcacaagt gcatctggcc
3961 agaccaatac actcctgacg ccactttgac gccacgtgac aatgaaatgt ttgttccgcc
4021 tgagtgggga gggccaatgt cgaaagccaa ccacattcct ggttacaaaa tgcagactgg
4081 atttccatgg aacaaagccc ccattcggtt tgttgaggga agtgttccag gaaccattgt
4141 cacacagatt agtcactgtg atggtagagg gattgcagcc gaagtgaatc cagcaacgca
4201 gcccaattgg tgctgtaagt cctgtacaag gattttccac tttgaagtcg atgggaaact
4261 ctattatcca atggagattc ggcccgaccc gaaaggaggg gaacagcaaa aagttcctgt
4321 agtggagaca cccattggag atgaagaaac cgagactgtt ggtggatggc tgggtagaat
4381 gtataacatt ccaggagctg agggatcata tgcggatttt cgactcccca agttgccaaa
4441 ttcaagacca agcgcaatgg tggggagttt ggtcaatcta ttatgcttga tgttttcaat
4501 tcagatagtt accaagacta tgcgggcaag aacgcttatg cgtttctatc tttgttgctt
4561 ggttttatg ttctttggaa tgccaacttt gtttggatta agtgggtttt tggcgtggat
4621 gatgattcta ccaatctcac acaactcggt aacaatgtgc aacctaaccg tgcatctgtg
4681 ggctgtactg ctaaaccaga gctcggcgat gtttctgtgg ggcctaacgc tccgatccca
4741 gatacagagg tctaccgctg gacagatgct actctttacc atgcagatgt tgcatcacgc
4801 catctacgcg cactcttggg tgttcgggtg ggtcatcgaa gtatgcttgt cagtcgggct
4861 tatgatgaac ttgttaaccg tcatcgatac ggttcacccg aaactgatcg catacttgct
4921 cttcttcgga tggaaaacgg gcatgtgcgt agtgtgcgct tggttattga tatactcaat
4981 caggagatgg aactctatag tcgccgcggc tccggccgcg ggcgggtgga ggtcagggta
5041 tcgaacaatg atgtcctcca gtttgattgt tatctttatc agtgtaggaa ttgcaggagt
5101 tatcgcttcg gactatggag gttatccggc tgcggctgcg gtgactgcag cattgttgat
5161 aatgggaatc aaaatgtttg actttctgac gacccgattg tctcttgagt tcgtatctgc
5221 aggcatgttc cccgaaggtg ttgaaaaagc ctttgaaccg gactcggtca gtgacttgtt
5281 tagggcatct ttcactgtag atgggataaa gttgcaggac catgttgaac cgatccccat
5341 tttgtttgcc attttgtaca tctttattgg agctgtggcc tgtaaggtta acccggccct
5401 cggaatagtg tatgctatcg ccatgttcgc gactccttta ccggagttaa tgcgtttata
5461 catgatgacc atctattcct ctacatttcg gacagacact ctgcttggga tggctatccc
5521 agaaacggag ccagaactgt ctcaagactt tgggccaatc cctgatggga tttatcgggt
5581 gaacaatcat ggattttcag tgaagagtca tcggggagtt ggaatcgtaa agaatggggt
5641 ttttcacact ctcatgcatg tcacgctcaa tgagccactc gcgtggcaaa atcgcctagt
5701 aggaccttca atgggccact ctctcaagga ctatgtcaca tacggtggaa actggcaatt
5761 gcctgacttt gatattgtta atgaggtggg cataatggtt tgtggacggg atcgttccat
5821 tcagtacaaa agacacgagg ttgggacaat catgatcgac gacaagcgag tgatgtactt
5881 cactcatgat tacgggcacg gatcatctgg ttcaccaatt tttgtgaacg gagaacctgt
5941 ggccttatac ggcttcgggt tccatttgta aataggtat cgatcaatag ttctgcctat
6001 cccacgtgaa gaagtccttg atggggctag taatgagggc ataccagctg agcacggaac

```
6061 catgcgcaac aagtttttg ttgactggca tccaggaaaa gggaaaaccc gaaaagtgat
6121 cgttaaagag gtgttaaatg ctttgaattt agcacggcgg attgttgttc tggccccctac
6181 acgagttgtc ctggctgaaa taactaaggc aataggggaa aacacatcaa aaacgccctc
6241 aaaaaatctt gctttcaccg gtcacaatat tgtgacggtg gcttgccacg cgacgttcac
6301 tgattatgtt ttgcgtcatg ggttatcaaa attcaaagct cacgaagtca taatggatga
6361 gtgccatttt ctggacccac gatctatagc tgcgagagga atcctggagc atctggcaac
6421 taaacgtgga gttaaagtca cgtttatgag tgcaacgatc ccaggacgtg aaccttcact
6481 cgggtcgaat tttgagatct ctgaacaggc cttgcagttt ccccgtgacg tcaaccaaag
6541 gtggatagaa actgttgcta ggggaaagac cgttgccttc gtgccatctc acagggtagg
6601 tgacaagcta gctcgcgggt gtccccaagc catttccctg cataggaaca attttgacac
6661 caattacagc acagctatgg atgagtccat aaaatttatc tacaccactg acatatcgga
6721 aatgggagcc aatttcagtg ctgacaccgt catagatttc cgggtggcga ttaagccaaa
6781 gatttctagt gaatttgccg tcactcttga accaactccg atcacgcgat catcgatgat
6841 tcaacggcgt ggtcgagttg gaagacaacg acctggaacc tatatttacc cagttgacaa
6901 aggcgtcgaa gatgcctccg atcagttggc ttgttggaca gaagctcaga tgttgttgga
6961 tcaattggac ttgacaatga tggcagagga agttcggcag tcaaacattc caggggctta
7021 caaattagtt gggcgtagcc tagacatatt tcggaagttg ctggagaagg atgacatacc
7081 aatctggctg agctggaagt gggccgacag tgttcaacaa caatactcca tattgtttga
7141 aggagaacgt caagagaatg tcgctcgtgt cgtcaacact cgagactatg cttctctaga
7201 gtataagccg aagtttgttg atgcacgatt cgagcgtctt ggatgggatc aacgaaagct
7261 gtcaattcag ttttacatga acactcggag cttcataact ttcgccactt tgtcacacgt
7321 catttctcaa gtgatcgaag ctggagttgt caattctgct tggaagcgaa taggagacgt
7381 tagcatcatc tttactgaag gaggcgaccc acatgctaaa gatgaaacta tcatggcttg
7441 gactattctg gttggaggag tgttgggggc tcttggattc ctcatagttg catggggaat
7501 gaaggctgtc ttgcgagtaa ttttcggatc ccgcgataag catcttagcg tcccaacctt
7561 agtggcggat ttccaaccat acatagtgtg tatagttccc attgccctac atcttgctgg
7621 ggttcctata ccaatgacaa ttgtgttttt cgcgatgctt ttcttgactt atccactaat
7681 gtacaagagt gccggacaac ggagttatgt tgacattgac ttggtgaaat ggattctgtt
7741 aggtggatgt attgtaactg gagtcatttg ctgggaaatg agattgctcc caaacatctc
7801 atcagacatt tcagctattt tgaataggca aagacaaagg gaagacaccc caacttttga
7861 tgcttcacca ccttgggaat ggttggattt agcacagcca gtccctcaca atgttgaatt
7921 gacgtcagtg gtgataacta cattcacgac ctgtctgttc ttgcaccaaa ttgtcggatg
7981 gtcatacgag tcagagtggc tgaaatccta tttcgaccac aaaggagtgg gtcagatcat
8041 gggtggtttt cggttggaca caatttcatg gggatcagct ctaagcggtc ttctgggcac
8101 agctacttat gcctcatggg gagccatttt gactgggtta ggaggagcgg ttgtgtattt
8161 tttcctgatg gtttcaatgc tcaagtggaa cttttcggga ggagccacaa ctggcttaga
8221 aaacaatgtc atgcgaaacg accgagaaac tggactaggt aatcggccgg caaacgacaa
8281 taggcgttcc ctcctgtacg gtgtggtggc ggctgaatgt cttgtgtggt tgttctgttt
8341 cagaactgcc acggatgcca tagtggtggc ttgtttagtg tcctattgtt tatggatcat
8401 caacaacccg gctagccctc accacaaaaa cactgactta ggatcggcgt gtagtttcat
8461 cggtctttg tactgtacat gtcctactca aaaatgcatc caagtattga tgaggtttgc
8521 tttggccagg ttgaacatga acacccgctc tctggaaaaa agcgcgacgg gaggccttgg
8581 acaccgttgg aagaagctat taaatgcgat gacactattg gaattcaacg cttaccgatc
8641 ttgtggagtt gacgagactg agaagggtga ctatgtgtca cgaggagggc tgaagctgag
8701 agagataacc atgaagtatg gttggaagcc agaagggata tgtgttgatc ttggatgcgg
8761 cagaggagga tggtcacagc acttggctat ggatccccgc gtaactagag tggaatcatt
8821 cacgttagga ggaacagcac gagaaaatcc ccagccaatc aagacacttg gtcataacct
8881 tatccggttc aagagtggag tcaatgtgta taatatgacg ccaacacatg ctaacaccat
8941 agtgtgtgat atcggagaaa gtgaccccaa accagaggtg gaaacctcta gaacattgcg
9001 ggtcctcaaa acacttgaac tatggttggc caggaatcca aacgctgaat tgtgtgcaa
9061 agtcctttgc ccatacccg tggaagtcct caaatgtctg gaaacccttc aacataagta
```

FIG. 46 cont.

```
9121 tggcggaaga attattaggt cgacgtatag ccgaaattca agtgctgaaa tgtattacat
9181 ttctggaggc cgtaacaaca tggtgaaggt tatcttcacc accctccact ccttgatttc
9241 gaggatacga actaggccgg agaaaatcgt caaagaaagt gtttctctac cagttgggac
9301 tagaagcgat ccagggcaca agatcaagag tatggatcca aagatgatag caacgcgggt
9361 ggaaaagata aaaaaggaac atgcggacac gtggttcgtt gacaacaacc atccatacca
9421 atcatttcgg tatgtgggat cgtacgtcac agatgatgtg acaccaggag gtcagactgt
9481 caacccatta atgagaaaaa tgatgtggcc gtgggagact gttggaggag ttgtaaattt
9541 catgatgacg gacgtgtcca catatgccca acagaaggtg ttgcgagaga aggtcgacac
9601 actatcccct gaacctccaa acgacattca aagggttaac agatggatca ccgagttctt
9661 gtgtgcttca ttcatgcgtc gagggttgaa acctagaatc ctgaccatgg agcaatatat
9721 caacaacgta aagagctcag ctgccattgg atcgtggagc agtgatgtcc cgtggagcag
9781 tgtccgagaa gctttagctg ataaaagatt ccaccaaatg gtcgaggagg aaaggaaact
9841 ccacttagca ggagactgcc gcatgtgcgt gtacaacacc atgggcaaga aggagaagaa
9901 accttcagcc atgggcgtgg ccaagggctc tcgaaccatt tggtacatgt ggttaggttc
9961 acggttttg gagtacgaag cccttggctt cttaaatgaa gatcattggg tgtcacgaga
10021 caacttggca tgtggtgttg gtggagtggg agtgaattac ttcggctact acctacaaga
10081 aattgcacgg aaagggaagt tttttatcgc cgatgacata gcgggatggg acacgcggat
10141 caatgagagt gacttggccg atgaggaatt tctcatcatg tccctcattt gtgacccata
10201 ccatgatcaa cttgcaaaag ccgtgtttcg gtttgcctac cagaacattg tggccttgtt
10261 tccgcgaaat catcctgggt ttggaagtgg aacggtgatg gatgtcgtgg ccagaactga
10321 ccaacgaggt tcaggacagg tcgtgactta cgctctaaac acgataacga acgccaagat
10381 tcaattaggc agaatgctgg aagccgaagg attactagac gctcatgaac atgtaatcaa
10441 aaaatggtta aacgacaatg gtgaagaggc tctctccggg atggtggtgg ccggggatga
10501 tgttgtagtt gcgaccaaca acggaaattt ttcaaggtcc ttacgatacc tccatttgaa
10561 cgggaaaatt cgtaaagaca ttgatccgtc cctaccgtcc aaagttgaaa cgaactggga
10621 ggtggttgaa ttttgttctc accattacca cgtgatgacc ttaaggacg gacgacgaat
10681 aattgtccca tgccgagagc agaatgaaat cattggacga ggcaggattc aaaaaggagg
10741 gttggtgacc cttgccgaaa gtgcctgcct agcgaaggct tatgggcaaa tgtgggcttt
10801 gtatttcttt caccgaagag atctgcggat ggcttttcta gccataactt cgagtgttcc
10861 aatagactgg ttcccagagg gccggacctc gtggtcgatt caccaaaata aagagtggat
10921 gaccactgag gacatgttgc gggtctggaa tacagtgtgg atccaggaca atccctggat
10981 ggaggacaaa atggaaatcg aaaattggag ggacattccg tacctcccga atccatgga
11041 cctaaagtgc ggcagtctca ttggaacaaa agaaagagcc gcttggtcaa aggatctgcc
11101 gtcaacggtc acggcagttc ggaaaattat cgaccaagac acgaaaaccg agaatgtcta
11161 ccaagacttt cttggcggaa tgggccggtt ccaaacgtac actgacccca tggcaacgta
11221 agaaaccatc ttttccaaat tagtcgaaaa atttgcccc tcttcgaggg gctttggcgg
11281 cagcaggaga ttttctccgg ggtttcacgc tccccccgat gccagtggtc acagcccaag
11341 tcagagactt ggagttgtgg cgggacagtg agctctgtca gtggtcaata gctcaataaa
11401 tatggcagca gagcttgtct cggggattca cgctcccccc attgtgagtg tgtcgaactg
11461 gtttcgaagg acgtctagaa cgacgctaaa gttcaaatcc ggcaacagag agttatgtc
11521 tcggggcctc acgcaccccc cgttgtgagt gaagtccttt ctggccattt agtggtcagg
11581 aagggtaccg ttttggaacg acggaaataa gttccatgga gcgacactag ccccactgag
11641 gggcggttgg aatgacaccc aacccgctat agtgcgtcga caggtcaatt agctacctgg
11701 aataagctaa tgtgcagggc aacaaagttc taacgaacta gggtgagtag cgtcaccccc
11761 cggttgtgaa aacgattgcg actagaacta aagtcgagag tctccccacc gataggggag
11821 ctcgtcagtt tgttttagtc caattacgct
```

FIG. 46 cont.

SEQ ID NO:38    CPEC WNV$_{KUN}$ vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgcttattt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata aacaatgtat ggtgctaatg ttgcttcaac aacaattctg
 481 ttgaactgtg ttttcatgtt tgccaacaag caccttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tagttcgcct gtgtgagctg acaaacttag tagtgtttgt gaggattttg aacaattaac
1021 acagtgcgag ctgtttctta gcacgaagat ctcgatgtct aagaaaccag gagggcccgg
1081 caaaagccgg gctgtcaata tgctaaaacg cggaatgccc cgcgtgttgt ccttgactgg
1141 actgaagagg gcaatgttga gcctgattga cggtaggggg cccacacggt ttgtgttggc
1201 tctcttggcg ttttttaggt tcacggcaat tgctccgacc cgggcagtgc tggatcgatg
1261 gagaagtgtg aacaaacaaa cagcgatgaa acatctcctg agtttcaaga aggaactagg
1321 aaccttgacc agtgctatca accggcggag ctcaaaacag aagaagagag gaggaaagac
1381 cggaattgca ttcatgattg gcttgattgc tggcgtggga gcagtcactc tctccaactt
1441 tcaagggaag gtgatgatga cggtgaacgc tactgacgtc acagacatta tcacgatacc
1501 aacggccgct ggaaagaacc tgtgcattgt cagagctatg gatgtggggc acatgtgtga
1561 tgatactatc acctatgaat gtccagtgtt gtcggccgga aatgatccag aagacattga
1621 ctgctggtgc acgaagttag cagtctacgt taggtatgga agatgcacca agacacgaca
1681 ctcaagacgc agcagaaggt cactaacagt gcagacgcat ggagagagca ccctatcgaa
1741 caaaaagggg gcctggatgg acagcaccaa ggctacaagg tacttggtaa aaacagaatc
1801 atggatcttg agaaaccctg gatatgcctt ggtggcagct gtcattggat ggatgctcgg
1861 aagcaacacc atgcagcgtg tcgtgtttgc cgtgttactg cttttggtag ctccagctta
1921 cagctttaac tgtcttggaa tgagcaacag agatttcctg gagggagtgt ccggagcaac
1981 atgggtggac ttggtccttg aaggtgacag ctgtgtgacc attatgtcca aggacaagcc
2041 caccatcgat gtgaagatga tgaacatgga ggccgctaac ttagcagaag tccgcagtta
2101 ttgctactta gccactgtca gtgaactctc caccaaggct gcgtgcccaa ccatggggga
2161 agcccataat gacaagcggg ctgacccatc ttttgtgtgc aaacaaggag tagtggatag
2221 aggttgggc aatgggtgcg gactttttgg taaaggaagc atcgacacat gcgccaaatt
2281 tgcctgttca accaaggcaa cgggaaggac tatcttaaag gagaacatta gtatgaggt
2341 ggctatcttt gtgcatggac caactaccgt ggaatcgcat gggaactact tcacgcaaac
2401 cggagctgct caggctggga gatttagtat cacccccgcg gcaccctctt acactcttaa
2461 gctcggagag tatggagaag taacagtgga ctgtgaacca cgctcaggga tagacaccag
2521 tgcatactat gtgatgactg tcgggacaaa gacttttcttg gtccaccgtg agtggtttat
2581 ggacctcaac ctcccctgga gcagtgctga aagtaatgtt tggaggaaca gagagacgct
2641 aatggagttt gaagaaccac acgctacgaa gcaatctgtg atagcattgg gctctcaaga
2701 gggagccctg catcaagctc tggcaggagc cattcctgtg gaattttcaa gcaacactgt
2761 caagctgacg tcaggccacc tgaagtgtag ggtgaagatg gaaaaattgc agctgaaggg
2821 gacaacttat ggcgtctgtt caaaggcctt cagattcctt gggactcccg cagacacggg
2881 ccatggtact gtggtactgg aactgcagta cacaggcacg gatggaccct gcaagatacc
2941 catttcatca gtagcttcat tgaatgacct aacgccagtg ggcaggttag ttaccgtcaa
```

FIG. 47

3001 cccctttgtc tccgtgtcaa cggccaatgc taaagtcctg attgagttgg aaccaccctt
3061 tggagattcg tacatagtgg tgggaagagg agagcaacag atcaaccatc actggcacaa
3121 gtctggaagt agcattggca aagctttcac agccaccctc aagggagctc agagactagc
3181 agctctggga gacacagctt gggactttgg atcggttgga ggagtgttta cctccgtggg
3241 aaaggctgtc catcaagtat ttggtggagc attccgctca ttgtttggag gcatgtcttg
3301 gataactcag ggtctgctgg gggccctcct attgtggatg ggtattaacg ctcgtgatag
3361 atccatagcc ctcacgttcc tcgcggttgg aggagttctg ctctttctct ccgtgaacgt
3421 gcatgctgat actggatgtg ccatagatat aagtcggcaa gagttgaggt gtggcagcgg
3481 agtatttata cacaatgatg tggaagcttg gatggaccga tacaagtact accctgaaac
3541 accacaaggt ctagctaaga tcattcaaaa ggctcacaag gaaggagtgt gcggtctacg
3601 atcagtttct agattggaac accaaatgtg ggaagcagtg aaggatgaac taaacactct
3661 tttgaaggaa aatggtgtgg accttagtat tgtggttgag aaacaggagg ggatgtacaa
3721 atcagcacct agacgcctga ctgccaccac tgagaaactg gaaataggct ggaaagcctg
3781 ggggaagagc attctgttcg caccagaact ggccaacaac acttttgtga ttgatggtcc
3841 ggagaccaag gagtgtccaa cccagaaccg tgcctggaac agcttggagg tggaagattt
3901 tggattcggc ctcaccagca ctcggatgtt cttgagggtc agagaaagca acacgactga
3961 atgtgactca aagatcatcg ggacagccgt caagaataac ttggcgatcc atagcgatct
4021 atcctactgg attgaaagca ggtttaatga cacgtggaag ctcgaaaggg cggtcctagg
4081 tgaagtcaaa tcatgcacgt ggccggaaac acatacctg tggggtgacg gggtccttga
4141 gagtgaccta ataataccaa tcacgctagc gggactgcga agcaaccaca accggaggcc
4201 tgggtataaa acacaaagcc agggtccatg ggatgaaggt cgagtggaga ttgactttga
4261 ttactgtcca gggacaacgg tcactctgag tgagagctgc gggcatcgtg gacctgccac
4321 ccgcaccact acagagagtg gaaagctgat aacggactgg tgctgtagga gctgcaccttt
4381 acctccattg cgctaccaga cagacaatgg ttgttggtat ggcatggaga ttaggccaca
4441 gagacatgat gaaaaaactc ttgtgcagtc acaggtgaat gcctacaacg ctgacatgat
4501 tgatccttttt cagctgggcc ttctggtcgt gttcttggcc acccaggagg tccttcgcaa
4561 gaggtggaca gccaagatca gcatgccagc catactgatt gccctgctag ttctagtgtt
4621 tgggggcatc acttacactg atgtgttacg ctatgtcatt ctggtgggggg cggccttgc
4681 agaatccaac tcaggaggag atgtggtgca tctggcgctc atggcaacct tcaagataca
4741 accagtgttc atggtagcat catttctcaa ggcgagatgg accaaccaag aaaacattct
4801 gctgatgttg gcagctgctt tcttccaaat ggcttactat gatgcccggc aaattttgct
4861 ttgggaaatg cctgatgtat tgaattcatt ggcagtggct tggatgatat tgagagcgat
4921 aacgttcacc acaacatcta atgtggtcgt cccgctgctg gccttgttaa cacctggatt
4981 gagatgccta aacctggatg tgtacaggat cctgctactg atggttggaa taggcagttt
5041 gatcagggaa aaaagaagtg cagctgcaaa aaagaaagga gccagtctgc tatgtttggc
5101 tctagcctca acaggatttt ttaaccccat gatccttgct gctggacttg tcgcatgtga
5161 tcccaatcgc aagcggggggt ggcctgcaac tgaagtgatg acagctgtcg gcttaatgtt
5221 tgccatcgtt ggagggcttg cagaactgga catagactcc atggccattc caatgactat
5281 cgcagggctc atgtttgctg cttttgtgat ctctggaaaa tcgaccgaca tgtggattga
5341 gaggacagcg gacatctcct gggagggtga tgcggaaatc acaggttcca gtgaaagagt
5401 tgatgttcgg cttgacgatg acgggaactt ccagctcatg aatgatccag gagcaccttg
5461 gaaaatatgg atgctccgta tggcttgcct ggcaatcagc gcgtacaccc cttgggctat
5521 tttgccttca gtagttggat tttggataac tctccaatac acaaagagag gaggtgtgct
5581 gtgggacact ccctctccaa aggagtacaa gagaggggac acgaccactg tgtctatag
5641 gatcatgact cgtggattac ttggtagtta ccaagcagga gcaggcgtga tggttgaagg
5701 tgttttccac accctctggc acacgacaaa aggagccgct ctgatgagcg gagaaggccg
5761 cctggatcca tattggggca gcgtcaagga ggatcgactt tgttatggtg gaccctggaa
5821 actgcagcac aagtggaatg ggcaagatga ggtgcaaatg attgtggtgg aaccagggaa
5881 gaatgtcaag aacgtccaga ctaagccggg ggtgttcaaa acacctgaag gggagatcgg
5941 ggccgtgact ctgattcc ccactggaac atcaggctcg cccatagtgg acaaaaacgg
6001 tgatgtgatt gggctttatg gcaacggagt cataatgccc aatggctcat acataagcgc

FIG. 47 cont.

```
6061 gatagtgcaa ggtgaaagga tggatgagcc ggttcccgcc ggattcgaac ctgagatgtt
6121 gaggaaaaaa cagatcaccg ttttggatct tcaccctggt gctggtaaaa caaggaggat
6181 tctgccacag atcatcaaag aggctataaa caggaggctg aggacggctg tgctggcgcc
6241 aactagggtt gtggccgctg agatggctga agccctaaga ggattgccta tccgatacca
6301 aacatctgcg gtggccagag agcacaatgg aaatgagatc gtcgacgtca tgtgccatgc
6361 aaccctcacc cataggctga tgtctcctca tagggtgcct aattacaacc tatttgtgat
6421 ggacgaggcc cacttcaccg acccagccag catcgcggct agaggataca tttccacgag
6481 agttgagctg ggggaggcag ctgcaatatt catgactgcc accccaccag gtacctcaga
6541 cccatttcca gagtccaatg caccaatatc cgacttacag accgaaatcc cggaccgagc
6601 ctggaactca gggtatgagt ggattacaga atatatcggg aagacggttt ggtttgtgcc
6661 tagtgtgaag atgggaaatg atagccct ctgtctgcag cgcgctggca aaaagtcat
6721 ccagctaaac agaaagtcgt acgagacaga gtatccaaaa tgcaagaacg atgattggga
6781 ctttgtcgtc acaacagata tatctgagat gggagcaaac tttaaggcaa gcagggtgat
6841 tgacagccgg aagagtgtga aaccgactat catcacggaa ggagagggaa gagtgatctt
6901 gggggaacca tccgctgtga cggcagccag tgcagcccag agacgaggac gcattggtag
6961 gaatccatca caagttggag atgagtactg ctatggaggg cacacgaatg aggatgactc
7021 gaactgtgct cactggactg aggcacgaat catgctcgat aacatcaaca tgccaaacgg
7081 attgattgct caattctacc aaccagagcg cgagaaggta tacaccatgg acggggaata
7141 ccgacttaga ggagaggaga ggaaaaactt cctggaattg ttgagaactg cagacttgcc
7201 agtatggcta gcttataagg tggcagcagc tggggtgtca tatcatgacc ggaggtggtg
7261 ttttgatggc cctaggacaa atacaatcct tgaagacaac aatgaagtgg aagtcatcac
7321 aaagcttggt gaaaggaaga ttctgaggcc acgctggatt gatgcaaggg tgtactcaga
7381 ccatcaggcg ctgaaatcat tcaaggactt cgcctcaggg aagcgctctc aaataggttt
7441 tatcgaggtc cttggaaaga tgcctgaaca tttcatgggg aagacatggg aagcactcga
7501 caccatgtat gttgtagcca ctgcagagaa aggaggaaga gctcacagaa tggctttgga
7561 ggagctacca gacgccctcc aaacaatagc tctgatcgct ctgttgagtg tgatgaccat
7621 gggagtgttt tttcttctca tgcagaggaa gggcatcgga aagataggcc tgggaggcgt
7681 tgtcctggga gccgcaacct ttttctgttg gatggctgaa gtaccaggaa cgaagattgc
7741 cggaatgctg ctgctttccc tccttctgat gatcgtgttg attcctgagc cagagaagca
7801 acgctcgcag acagacaacc agctagctgt gttcctgatt tgcgtgttga cccttgtggg
7861 tgcggtggca gccaatgaga tgggttggct ggacaagacc aagagtgaca taagcggtct
7921 gtttgggcaa agaattgaaa ccaaggagaa ttttagcatt ggggagttcc ttttggacct
7981 gaggccggca acggcttggt cactgtatgc tgtgactaca gcagttctca ctcccttgct
8041 aaagcacttg atcacgtcag actacatcaa cacctcattg acctcaataa atgttcaagc
8101 tagtgcgcta ttcacgctcg cgcgaggctt cccttttgtc gatgttggag tatcggctct
8161 cctgctagca gccggatgct ggggacaagt cactctcacc gtgacggtga catcagcaac
8221 acttctgttc tgccattatg cctacatggt acctggatgg caggctgagg caatgcgctc
8281 agcccagcga cgaacagccg ctggaatcat gaaaaacgct gtggtagacg gcatcgtggc
8341 cacgacgtt ccagagctag agcgtaccac acccatcatg cagaagaagg ttggacaagt
8401 tatgctgatt ttggtgtctc ttgccgcatt ggtggtaaac ccgtctgtga agacagtgcg
8461 ggaagccgga attctgatta cggcagcagc tgttacccctc tgggagaacg gagcaagctc
8521 tgtgtggaac gcaacaaccg ccataggact tgtcacatc atgcgcggag gctggttatc
8581 gtgtttatcc ataacatgga ctcttgtaaa aaacatggaa aaaccagggc tgaagagagg
8641 tgggcaaaa ggacgcacct tgggggaggt ttggaaagaa agacttaacc agatgacgaa
8701 agaagaattc atcaggtacc gtaaagaagc catcactgaa gttgaccgct cagcagcaaa
8761 acacgctagg aaggaaagga atcactgg agggcatcca gtttctagag gcacggcaaa
8821 gctaagatgg ctggtcgaga ggaggtttct tgaaccggtc ggaaaagtga tcgaccttgg
8881 atgtggaaga ggcggctggt gttattacat ggccacacaa aaaagagtcc aagaagtcag
8941 agggtacaca aaaggtggtc ccggacatga agagccccag ctagtcgaga gctatggatg
9001 gaacattgtc accatgaaga gtgggtgga tgtgttctat aggccttctg aatgttgtga
9061 cactctccctt tgtgatatcg gagagtcctc atcaagtgct gaagttgaag aacatagaac
```

FIG. 47 cont.

9121 gctacgagtc cttgaaatgg tggaagactg gttgcatcga gggccaaagg aattttgtgt
9181 gaaggtactg tgcccctaca tgccaaaggt catagaaaag atggagctgc tccaacgccg
9241 gtatggcggg ggattggtta ggaacccact ctcacggaat tccacacatg aaatgtattg
9301 ggtgagtcga gcctcaggca atgtggtgca ctcagtgaac atgaccagcc aggtactctt
9361 aggaaggatg gagaagaaga cctggaaggg acctcagtac gaagaagacg tgaacttggg
9421 aagcggaacg agagcagtgg gaaaacctct actcaactca gacaccagca agataaagaa
9481 caggattgaa cgacttaggc gtgagtacag ctcgacatgg catcatgatg agaaccaccc
9541 atatagaacc tggaactacc acggtagcta cgaagtgaag ccaacaggct ctgcaagctc
9601 actggtcaat ggagtggtca ggctcctctc gaaaccatgg gacaccatca caaatgtcac
9661 cacaatggcc atgacggaca ccacccttt tggacaacag cgagtgttca aagagaaggt
9721 ggacacgaaa gctccggaac cgccagaagg agtgaagtat gtgctcaatg aaaccaccaa
9781 ctggttgtgg gcgttcctgg cacgagaaaa gcgtcccaga atgtgctcgc gagaggaatt
9841 tataaggaag gtcaatagta atgcagctct gggcgccatg tttgaggagc agaatcaatg
9901 gaggagtgct agagaagcgg ttgaagatcc aaaattctgg gaaatggtgg atgaagagcg
9961 tgaggcgcac ttacgcggag aatgtcatac ttgcatttac aacatgatgg gaaagaggga
10021 gaaaaaaccc ggagagtttg ggaaagccaa gggaagcagg gccatctggt ttatgtggct
10081 gggagctcgc ttcctagagt ttgaggctct gggcttttctt aatgaggacc actggcttgg
10141 aagaaagaac tcggggggcg gggtcgaggg tctgggcctc cagaaattag gctacatcct
10201 gcgtgaagtt ggcacccgac ccggaggcag aatctacgct gatgacacag ccggttggga
10261 cacccgcatc acaagagctg acctggagaa tgaagccaag gttcttgagt tgttggacgg
10321 ggagcaccgg cgcctggcca gggccatcat tgagctcacc tatcgccaca aagtagtgaa
10381 ggtaatgcgc ccggctgctg atggaagaac cgtcatggac gtcatctcca gggaagacca
10441 gagaggaagt gggcaagttg tcacctacgc tctaaacacc tttaccaacc tggctgtcca
10501 attggtgaga atgatggaag gagagggtgt gatcggccca gatgatgtgg agaaactcac
10561 aaaggggaaa gggcccaagg ttagaacctg gctgtctgag aatgggggagg aaagactcag
10621 ccgcatggct gtcagtggag atgactgtgt ggtaaagccc ttggatgatc gctttgccac
10681 ctctctccac tttctcaacg ccatgtcaaa ggtgcgcaag gacatccaag agtggaaacc
10741 atcaaccgga tggtatgatt ggcagcaagt tccattctgt tcaaaccact tcactgaact
10801 gatcatgaaa gatggaagaa cactggtgac tccatgccga gggcaggatg agttagtggg
10861 cagagctcgc atctccccag gggctggatg gaatgttcga gacactgctt gcttagccaa
10921 atcttatgct cagatgtggt tgctcctgta cttccacaga agagatctgc ggttgatggc
10981 caacgccatc tgctctgccg tacctgtaaa ctgggtccct actggaagaa ccacatggtc
11041 catccacgct ggaggagagt ggatgacaac ggaagacatg ctggaggtct ggaatcgtgt
11101 ctggattgag gaaaatgaat ggatggagga caaaaccccca gtggagaagt ggagtgatgt
11161 tccatactct ggcaaacgag aggacatttg gtgtggcagc ctgattggca caagagcccg
11221 ggccacgtgg gcagaaaaca ttcaagtggc catcaaccaa gtcagatcaa taattggaga
11281 tgagaaatat gtggattaca tgagttcatt gaagagatat gaagacacaa cattggttga
11341 ggatacagta ttgtaaatac tttgttaatt gtaaataaat attgttatta tgtgtagaag
11401 tttagcttta taatagtgtt tagtgtgttt agagttagaa aaattttagt gaggaagtca
11461 ggccggaaaa ttcccgccac cggaagttga gtagacggtg ctgcctgcga ctcaacccca
11521 ggaggactgg gtgaacaaag ctgcgaagtg atccatgtaa gccctcagaa ccgtctcgga
11581 aagaggaccc cacatgttgt agcttcaagg cccaatgtca gaccacgcca tggcgtgcca
11641 ctctgcggag agtgcagtct gcgacagtgc cccaggagga ctgggtgaac aaaggcgaat
11701 caacgtccca cgcggcccta gctctggcaa tggtgttaac cagagtgaaa ggactagagg
11761 ttagaggaga ccccgcgttc tgaagtgcac ggcccagcct ggctgaagct gtaggtcagg
11821 ggaaggacta gaggttagtg gagaccccgt gccgcaaaac accacaacaa cacagcatat
11881 tgacacctgg gatagactag gagatcttct gctctgcaca accagccaca cggcacagtg
11941 cgccgacaat ggtggctggt ggtgcgagaa cacaggatct

FIG. 47 cont.

SEQ ID NO:39   PCV genomic nucleotide sequence

```
   1 agttttaaaa aacttttgcg ttagtaaaac cacggagttt tggtttgctg agaatagtgc
  61 gagggttgtt ttaattattt cggagatttt ggttcgtgat gaatcaggag agaggaatac
 121 tcaggggtat ggggaggttc ccccccccccc ctgtgaagaa ggggaacaag aattctgttg
 181 ccgtggccag ggtgccaccg cagcaaggag gaaaagcgag agagaaaaac cgtgagagga
 241 ttaaagcgcc aggagcgcga catggagttg ccggaaagat gaaaagtcta atgggagaat
 301 tgggctttgg atggattgat ttactacgcg ttgatttggt ggaaggaatt atgatgatgg
 361 tttttgttat acagcgggct ttcgcccaag tgcaccggag aattagagga ttatcaagac
 421 gcgtcagggc attggagaag aagcgtgacg gtcgagcggc tatgttcatt tggactatat
 481 tggcaatgtt attcggagtt atgggagttg tggtgattga catgcgtgtg acgtatgacg
 541 gacaagtgca gatttatcgc gacggagaga atatgacaga tcgagttgcg ctctttaagc
 601 tgccaactga cggttgttca gttgggttgc cagtttcaaa gatgtgccac aaagtggata
 661 aaaacatgaa agaaggatta gcggacacgg attgcggatc aacatgggca gagtttaggt
 721 tgagatacca acgatgccaa gtgaagacac gagcgaagcg agttgcgcca gatggcccaa
 781 agcaagactt tttggcagaa gtggaaatag tggcttttaa agccatccgg gaaaacaaaa
 841 gtgtgttgct tgtggtcgtg ttgtgcgtgg ccatcgcgaa aagatggcca ttgtgggtgt
 901 tgatactact gtcgattgga acatggacaa cggttcgagg agaatacatg gaaccgttgt
 961 atgtattgaa agcagaccag atgacaatga ttcagacaac gttgaggcca gaagagggat
1021 acgtgacagc gacggcaaat gggttatttg agatgaaaac aggaagagcg ttcatctatg
1081 gaagccaagt ggtgaaaaca ctggtaactg actgtgaagt taacgcgaca tattcaactg
1141 atatatgccc aggcggatcg cagctgtcaa tgcaggacat tcaagcggaa ggaagagcat
1201 gtgcctcgga gccgtataat cgaggctggg gcactggtg ttttaagtgg ggagttggat
1261 tcgtagcaac atgcgcggag gttgattgca ccactagtgt gaaagttagc tcagtggctc
1321 gctcgacaat taagatgaat gtgacggcaa cataccactc agtgaaaagt gtgcagagtg
1381 tgataagtga tgtacctgtg acattccaat ttgggcagct gggcattgcc tctatgacat
1441 gtcgtttgga gtccgaccga attgcccaat catactatca cgtggaagga acaagaagg
1501 agggactatt catgaaggaa cagattgatg gatggaacgg agccacgttg gctgctggaa
1561 agatagccaa cacagagaaa attgttattt ggggagatgt gaaaccaaat gaaattttgg
1621 ttaaggcggt ttcagaaccc caactggaat ggactaatgc tatagctaca catgatggct
1681 tccgagatgt gggatttgtt tgccagataa tgcttgacaa gcttgttacc ggagtgttta
1741 aagattgtaa gaccccctaaa acgtccacat tcacacaaag cggatttggc tttgacggaa
1801 ttataactac cacgttagct gtcgcccaaa ctgaagcctg ctcgatcagc atctcctgta
1861 aaggatgcac gcttttggca acaaaagcag tgttttccgc tggggatatt gagtcgaaga
1921 catgggtgcg atgcggaaac gagagtggaa cagcgatcgt tggaggacaa gaagttgccg
1981 ttgcgtgcgc cacaaatccc atcacgcagg gatggagatt ggtgaagcat gctactcaac
2041 gttaccggaa gtttggaatg ccaggagtag gtggagtatt ccacgattta gtgggaacat
2101 taaatccatg gagtttcttc tctaccacga ctctggtttt catggcggta gtccttttca
2161 tcgtggacaa aagaatcttg attttgggga tagcttgtta tatgttttat tttgtgcgag
2221 ccgacttcgg atgtggattt gacccagata ggaaggtagc acagtgtggt tctggctcat
2281 tcgtgtggaa gtcactggcc cgttggccaa tggctgatca cgctattgag tttgaagata
2341 gcaaagtgat ggtgacttac ttgactgacc tattgatgag aaagaacaaa gtctgcatag
2401 tgtgtgaaga tgtattgcag tgtgccgcag cgcgtggagt tgtcgagcag ataacgtcga
2461 tcaatggaat cccaatccat cacaacatgt cgctgtcgca tggccgatat ttcccacgtg
2521 tagtgaagaa agtacacaat gttaaggtgg gaaaagccat gttgcgcctt gcaatggcca
2581 catatgcggg agcgatgcct gagagtggat tgggtgtttt gaagacgggg tattttttcac
2641 gcggagaagt gcaggaaacg tgggatgata aagttctaag agtcctaacc agcgccataa
2701 atgcagagga agtgtgccag acggctgtca cgttccagta tgagttcgtt cgatataacc
2761 ggaaagtctt tggatctaac atcgtgttgc gaccttcagc ctttacgagc aaagcttgcc
2821 caacatattt agctggggct gtggtcaaaa acgacatagc aacgtttacg gacgaaatga
2881 tgtggatgcg gagccggaaa gtcaatgaaa cgtgggaact gtttgagttg gaaacaaccc
2941 aaagccacca atgcatttgg ccatacgcgt acacaataga cctagcaaca cccacggaca
```

FIG. 48

```
3001 agaggctttt catgccgcca caatacggag gaccaatttc gtttgcgaac cacgtgcctg
3061 gattccaggt gcaagaggac tttccctggc agaaggcgaa tatattaatg cgccagggac
3121 cggttccggg aacgaccgta gtccaggatc cacactgtga tgaccggagc gcggcagtgc
3181 cagttgaacc aactatgcaa gcttggtgct gcaagacctg ttttgataga ggagtgaagc
3241 ctttccattt tgtggttgac gggaaatttt tctatccaat ggaagtgcgg ccaatgaaac
3301 tggaacaaga cgctgtggtg attgagactg atgatggaga gttcgagagg agtgagcatg
3361 agagcttgtt tgaaggcaaa gcaaagtgga catcaccgtt accaatggga gaaacagcca
3421 agattcaaaa ttttttcgtg accagcccgc caaagccgga atcaagcctg cttttggtgg
3481 gcgttctgat tcatatgtta acaacgcgaa cccgccatcg gtgggcaact cgttgtgctg
3541 gaacttggct catcttttg gtctttggac atccggttgt gtcttcggtg cagtcttggg
3601 cgtggctctt tatgtcagct gccttagcaa gtgtccctgg tggttcttca ctggtgatcc
3661 acttctggat tgggttgcag atatcgtcag cgcacctctt ttacctgggt tggttaatga
3721 ggaaacgcct gttgattaca gagatgtcgc gagtggcaca tctgattgcc cagttgtgca
3781 gcttcgagac atatgcgtgg gcaccgatcc tcaaagtact ggatcacttg ctgtttccac
3841 tctacactct gtcagtattc gtcgttcacc agcagtttca ggtattccac gacttgtggc
3901 tacagagcgc cgtggtgatg gcacacctgt tgcaacaccc tctcagtggt ttaataacct
3961 tgagtttaag cgtcggcttg attcagctaa tagcaccaat gaaaagatgg ttttgctcac
4021 cagttatatg gggagatggc ttacgcgcgc cgagaccaca ctggacagcc ttaacgtatt
4081 tcatcgtgct gtatttggca gccgctggga tggagacagt gggtctgcac acgtccggga
4141 tgacagtgat gctgggcggg atgcttctgt gggttgtcct acagttgatg cccccgacag
4201 ccttggaact tgtgcgccta ccgggacaaa gtctgccaga cggatgtgaa gaagaagcgt
4261 caacatctct accagaagga atgagtgggc attacgcccc cgatggagtt gaactcgtga
4321 actacacaga tgcagggact gtctccgcaa accttgtggt atttgttggg tgtgctggaa
4381 ttatgactat gaacatatac gttgggttgg ttatcacggc cttggcctgg gtaacggacg
4441 ccccgatgtg gattccaaga ttgattgatg gtgctatgtc ccagcgggca aattcggagc
4501 tattgctgcc atccccacct cttgagatac acaagacgga agactcgttt ggttacatcc
4561 cggacggaac atatcacgtg ttggctagca gctggatgag caagaaacca gttggtgttg
4621 gagtggtgaa ggagggcgtg tttcacacgt tacaccacgt caccaaagga gctaatgtga
4681 catgggcagg acgtgaggtt aggatgcact ctggagatgt taggcgggat attgctgcct
4741 atggcgggcc ctggaacatc agcgggagtc ttgaagatgt cgtagtagtg aaggccgtga
4801 acaaggatgg aaccgtgaca tgctgccgga ttacaacagc taagttggac attgaaggaa
4861 ctacagtgat ggctgttgag cgagattttg gtttcggctc ttcgggggtcc cccatatacg
4921 ctcctgatgg acggttgatt ggcttgtatg gatacgggtt ttactatgga acgtacttct
4981 caatagtttc aacaggagaa ggagtggagg caccaccgga agaggttgaa gtctcaacac
5041 gtgagttttgt ggactggcac cctggaagag gaaaaacgcg cacgatactc gttgagcagg
5101 ccctgaagca tatagctgat ggaaagaggt tgctaatttt gacaccaacg cgggtcgtaa
5161 aggatgaagt gcagcgagcg ataaaggaag ccgccccgca ggcggttatc ggatcgaact
5221 taagcatttt tcggaagaac gccgttacct tggcatgcca cgcgaccttc acgcagtatg
5281 tgatggagaa ggggatagaa agtgtgaagt tttcgaccat cattatggac gagtgccact
5341 ttctggaccc gatgtccatc gcgtgccgcg ggataatgga tttccacaac agccgtggaa
5401 cgaaggtcat cttcatgagt gcgacgcccc caggacgagc aggaaacgct gggtccaact
5461 ttacaataga agacagagcc atcaagttcc ccaaggagtt gaccgcatcg tggatcaaag
5521 acaagtcaat aggcaagacc atcgtttttg tgccaacaat tacgcaagct gtgaggctgg
5581 ctaaagagtt gggagggggtg gccttgaccc gagatacgtt caatgatgcc atggggaagg
5641 cccggagtcc ggaaacaatg tttataatct caacagacat cagcgagatg ggagccaatc
5701 tcggagtgac tactgttatc gacacaagaa ctgttataaa accattagtg tctgacaaag
5761 gagtttcact tgaaagggt ggtgtgaccc cagcttcaat catccagcgc aggggccgag
5821 taggtcggcg ggagcccgga gtatacattt atcccccttga cgtcgaacca gaggagcagc
5881 cggaaaattg ggtgtgttgg gtggaggcgc aaatgatctt agatcaattg ggctgccatc
5941 cgatgagaga ggagagcgaa tttttccgcc cacaaggcac gtaccggatt gacgacgtag
6001 agcagcggag gtttctgggg ttgatcaagg aaaaactgcc aatttggctt gcttggactt
```

FIG. 48 cont.

```
6061 gggccagctc acatgcgaac aaacatcaga tgctatttca gggaaacgcc cccaacactg
6121 gacgaacatt aaaaataaag acgccatccg gatctcacat ttacgcccca aaggtgacag
6181 atgataggtt tgaaaaggag ccagaaattg tgaaagtggc ggccatcgga ttcttcctaa
6241 agcagagatc actatacttc gacttacctg gattattgac cggattgtac acggtgttga
6301 caacggctgg gctcgatgcc cttggaaatt cgttcaaacg ctctgtggac acccttcacg
6361 acatcggaaa tgcggtggaa ggagagtttt ctgctataca aatgggacgg attttacaga
6421 tgtggtctgc gttgtttatc ggggtgactt tgggagttgt gctgatggga gccggatttg
6481 ttgtggtgaa ggcttttaga ggattgtttg gaacccgcca acaacacaca actgtgtgcg
6541 tgtcggaggg cggaagtttc caaaaagttg ccacggttct aatgagcgtt ggaccattgt
6601 gcgccgtttt tggtggcatt ccctctatat tcgtcttcat tgtgaccgtt gccctgttga
6661 ttgtgctgtg tgtgggcgga ggtggctctc aacgtggtgt gcttgattcg gatctaatac
6721 gctgggtcat ggtgttggcc atgatgacaa tcggagtgac tgcgtgggag ttggagctat
6781 taccaaacgt gagaagagat gttatacagt tgactcgata cctgtttgct agcaatcctg
6841 ccgttgttgg agctgtgttt aacgccggga atatcggatt gggagtctct ctgccaggga
6901 ccctcatgat gagctacgcc gcgagcggaa cgctggcccc ccttattgga gcgtgggccg
6961 aaggaaattt cttaggaaag ctctttggta gcgaagtgct tccagctcag gctataggcg
7021 gatttcaagt gacagctatc ccgtgggggat ctatggtgcc ggttatcgct ggttgctttc
7081 tagcgacaaa cactctttcg aaagtgtttg gtgctggaat tacaactgtg tttctcatac
7141 tactctactt cgacaagaaa catgcattca cgaacaaggc tgttaaggtt ttgttggcgc
7201 ggacaaacag aagggacatg gaggaagaaa tcacaacaag ggacgcggag tcgcgggctc
7261 gccaactgtt ttatggccta caactggccg tatcgttgct gtgggttctc tcacatcctg
7321 tgttggaaaa cttcgttcca ttctttgctg tgtgcgggta cacattcctg tcgctcttga
7381 ggccaaatca tcaactacat gctgcgttgg attatacatt ggtagtcctg ctcttgcagg
7441 tagttgaacc tgggaacatc atgtacgtcg gcggatgcgt tttgttatgg tatgtttaa
7501 accctaccag attgggcgtg cgctcgctgg tgaagagtga caccggaggt ttaggcttcc
7561 gttggaagaa agcgttgaat tcacttagtg agaggcagtt tgccatctac aaagtcagag
7621 gcgtgaatga aactgataaa ggagcctacg tgtcgcgagg tggtttaaaa atgaacgaga
7681 ttatcaacaa gcatgcgtgg gaacctcgag gagttgtcgt tgacctggga tgtggacgag
7741 gaggttggtc ccagcgcttg tgtgatggatt accgcgtcgc tgaagtaaga ggatacacac
7801 ttggaggcaa agaacgtgag aatccccaac cgttccaaac gaaaggatat aacttggcga
7861 atttgaaggc tggagttgac gtctataaaa tggagccagt gaattgtaac accataattt
7921 gcgacatagg tgagagtgac ccgcgtcctg aagttgaaaa aactcgaacg ctgaaggttt
7981 tgggaatgct ggagaaatgg ctggaagtca atccaaacgc ctcttttgc tgcaaagtgc
8041 tatcacctta tcacttggac gtgcttcgaa agttagagtc gctgcaacac aagtataacg
8101 ggcggctggt tcgactgtct tacagtcgga actcaacagc agaaatgtat tatgtgtcag
8161 gaaagagggc aaacgtggtg gcaagcgtgt acttcatgct tgggtcgctg gtaggtaggc
8221 tgcggagaca tgagccatca atcatcgacc ccccaccggt tctagagatg ggaaccagaa
8281 gcgatccgcg agcaaaggcc aaagcgcaag acttcgagat gatccgaaga agagtggaac
8341 gactacgagg agaaaatcgg aaaacatggt ttgtggacaa cgaacatcca tatgtgtcat
8401 ttaactacca tggatccttc gtgactgatg aggtgacagc gggcggacaa acaacaaatc
8461 ccttgattag acgcgttatg tggccatggg actttctgtc tcgggtgaca accttatga
8521 tgaccgatgt ttcaacgtat gcccaacaaa aggtgctgcg tgaaaaagtg gacactgtct
8581 ctgaggagcc cgacgagcga atgaaagcaa ttaacagact catcatgaca cacttcgtga
8641 aaatgttcaa gcggcgcggg ctgaaaccga gggtgttgac accacaagac tacatgaata
8701 atgtccaagc caacgcagcc ataggaggat ggagcgaagt aatggattgg caaaacgtgc
8761 gcgatgcttt ggcagatcaa cgattctggg acatggtaga taacgagagg gccttacact
8821 tgcgtggtga ctgtgagctt tgcatctata acacgatggg aaagaaagaa aagaagccat
8881 ctgcctttgg cactgcgaaa ggttcacgca ccatctggta tatgtggctg ggtagccgtt
8941 atttagagta cgaggcttta ggattcttga acgaagatca ttgggttgca cgagaaaact
9001 ttccatgtgg agtcggtggc gtcggcgtta actattttgg atattacctg aaggaaatag
9061 ccgggggagg ccggtggctt atcgcagacg atgtcgcggg atgggacacg agaataaccc
```

FIG. 48 cont.

```
9121 aaggagatct agatgatgag ctgttcatgt taaccgagct tgccccaacc acataccaca
9181 agaaattgat aactgcgaca atgacgttgg cttataaaaa catagtggcc ttattcccta
9241 gaaatcatcc gatgtaccga agtggaactg ttcttgatgt gttgtctcga acggatcagc
9301 gtgggtcggg ccaggtgaca acatacgctt tgaacactgt gactaatgga aagtgccagg
9361 tcgggagaac attagaagcg tgtggcttgc tggacgcccc gctcaccaca atcgactcct
9421 ggctcactgc caacttggaa cgagttcttg gagcaatggt cgttgccgga gatgatgtgg
9481 tagtggcgac agacaatgaa gaattccaca cgagtttgag atacataaca gcgacgtcaa
9541 agatccgaaa gaacttaggg gtgagtgagc catcgccgag attcacgagc tgggaagatg
9601 ttgagttttg ctcacaccac ttccatccac tgacgttacg tgatggccgt gtgctgatcg
9661 ccccgtgtcg tgaccaaaac gaaattatcg gaagatcaag aatccagaaa ggcggaatag
9721 ttgacatggc ctcggctggg tgcttagcga aggctcacgc gcagatgtgg gccctttact
9781 tcttccatcg gcgagactta cggattggat tcgcggccat cacatcaatt gtgcctatca
9841 actgggtgcc gacgggcagg atatcatggt ctatccacca gaacgcagag tggatgacga
9901 ctgaggatat gctaacggtt tggaacaacg tgtggattag ggacaatccg tggatgagag
9961 gaaaagaacg agtgacttca tggacagaca taccgtattt acccaaagga gtggacataa
10021 agtgcggaag cctaataggc gattccgacc gcgcttcctg gtcaaagacg attcccctag
10081 ttgtggagaa gacccgaaaa atccttgagc aggagagggg aacattgaag ttctacaatg
10141 ggttatccat tctaggacgg tatgttcacc acgtcgatcc tgtgttcaac tgaagtgtga
10201 cgatgtaggc ccgcgggagc cttagaattc aagagcttgg gaattctaga atcccgttta
10261 ccgcaggagg gggtcatatg gagcaggtgg ctatgtatag cctggctaaa tgtatggctc
10321 ctgggggagt gacgcccctc cggttccagt tcctgggtga acaggtaaaa accaccacga
10381 agcgccgctt caacatcgca aggggagaa atcccgggtg ctgacgccac cccgaccccca
10441 gtcccacata aggctgtgac gaaagagcct taccggcacg aggagtgccc accgcaagga
10501 ggagaaatcc tggcgttga cgacgccccg gccccagtct ctgataggtg accagaacca
10561 tgtcaccca aagtgttgaa aggacactga tcaccagaaa tggtgagggc acacagggct
10621 tagcccaagg tgagtgacga cacctcccga aatgtgtaaa tagcagggtc agctctaagc
10681 agcaggcttc caccgttagg aagcgttgct gtgagcttac ttggctacgt ct
```

FIG. 48 cont.

SEQ ID NO:40     BinJV genomic nucleotide sequence

```
   1 agtatatttt gcgtgtgcgt ttcaaaacac agattgtatt gaaagtacgt aagagtataa
  61 cacgttggaa taaagttttg gatcaagagg aaaatcatgg ttacaaaact caggaggccc
 121 gttaaacggg ccgtcgatat gatgaggcgc gcggtacccc gcgccgcagg accccggcgg
 181 gtcctaacta gggtatcaaa taccgtgaag cgtaacgcag gcgctcttag agctcttctg
 241 gcttatctgc tgtaccagac attctctggg cggaaagttg gtagtggtgc tcggagcgcc
 301 cttaagcgct tcaacaaaaa tgacattgtg aaaatgttgc tggcgttcag acggacattg
 361 acaaacatca tcacaaccat gcagcgtcgt gtgaaaggaa agaaacgtcg tggcgttcaa
 421 gatgtgccgc tattggtctt gctgctcgtt ggagcaggag cgatggctgc cactttacgc
 481 accgttggag acttgacatg gctaaatgtg tcaaccactg atgttggaaa gtggatacgt
 541 gtggagaata ggcacggcaa aggagagtgt ttcgtcacgg ccactgacgt tggaacatgg
 601 tgctcagact ctgtgggata tgaatgtcct caaattgcac cggcgtatga ccctgaagac
 661 ttggattgct actgccgaaa cacctcaacc tacgttactt atggaaggtg taaaaatggg
 721 cgcagtggac gatctcgcag caagagagca atcacgatag ccccgcacgg cgaagcagga
 781 ttgcgtgttg gaagcaccaa gcattggact tctagagcaa ctccacaacg gtatctaatg
 841 cgcgttgaga aatgggtgct gcggcatcct ctacctgctc tcgtgttggt ggtactggga
 901 tggatgatgg gtcgttctca cggccagagg gccatgtata tagtgctgat gctgcttgtg
 961 gctccgtcat atggtaacca atgcctggat gtgcagtcac gtgatttcgt gcaagggggtt
1021 agtggtggca cctgggtaga tgttgttttg gatcatgaca attgcataac cattgttgct
1081 gacgggaaac catcttttga tattcgtttg tcgaaaatga gcatgtctaa attcgcagag
1141 tacaaacggt attgcctcca ggccacgatg agtgatgtca ctagcatagt ggcgtgtcca
1201 ggggctgggg atgctcataa tgacaagagc aaaaaccacg agtacatttg caaagctgtt
1261 aacaatgacc gcggatgggg caatgggtgt gtccttttg gcaaaggatc aatggaaact
1321 tgtggtaagt ttgaatgtaa gaagaaaatg gctggcaagt tagtggcacg tgagaacgtg
1381 gaatcagtgg tcactgtgca tgtacatggt gcctccgcaa ctgacacaaa aggagttgac
1441 accgcctcta cagccaaagc gactatcacg ccaaaagctt ctgtggctac tctaaattta
1501 aacgactttg gtagcctgga ggtggattgt tcaactgatg ttggcatgga ctttggagag
1561 attgtggtgg ccgacatgtc aggaaagtgg tggatcgtga caaggattg gttcaatgaa
1621 cttgctttgc cgtggtccac ggctagcacc actgctgaag tttggcaggc acgagacaga
1681 cttgttgagt ttggatggcc acatgcggcc aagcagaaca tctatgacat tggggaccaa
1741 gaaggagctg tgacggctgc catagcccag gcacccatgg cgaaatggga gtctgacaag
1801 gtcgagctaa tctctgggat tctcaagtgc aaggtgaaac ttggcaacct aaagctgcgt
1861 ggggtgacct atagcatgtg tgcccagaca ttcaccacgg aaacaaggcc ggccgacacc
1921 ggacatggca ctgtggcttt caaggtgaaa tacgtcggaa cagacgtgcc ttgccgggtc
1981 ccactccaca tcatagacag tgacggcgga gtggccgctg gacgagtgat aacggcacac
2041 cccttcgtca tgaagcagaa tgattacatt attctggaag ttgaaccacc cttcggtgac
2101 agcaaaattg agattggaac aggaacaaca aaactcgttg aagcatggca tcgaaaaggt
2161 agctcgatag gaaatgcctt tacggccact tacaagggca tcacaaaatt gacagtgctt
2221 ggagaacatg cctgggattt taattcacta ggtgggtttg gagcaagcct tgggaaggcg
2281 gtccatacac tgtttggagg tgtattccgg gtgatgttcg gaggcatggg atggttaacc
2341 aagatctttg tgggtgctgt cctagtctgg ctaggattag gagctcatga caagacgatc
2401 gccaccacca tgatcctggt aggatccata ctgatgtaca tggcagtgac cgtgggtgcc
2461 ctatcggaaa taggatgcag tctggacatt agccgaaaag aaatgaagtg tggggacgga
2521 gtcttcatct tcagagaggc aggcatgtgg aaggatgggt atgcgttcca cccttccgaa
2581 cccaaatctc tggccgcgtc agttctcaag agttggcagt ctggagtgtg cggcgtgcgc
2641 tccacgaaca gaatggaaca tgccatgtgg aaacagattg aaaatgaatt gaacggcatt
2701 ctagaagaga atgaggcgca actcagcgtg gttgtgcgag agtctaacgg gaccttcccg
2761 agaggagagc gccgcatgca cgtggccgaa cctctgcgct atggatggaa gacctgggga
2821 aagaccgcaa tttcgacggt gccgctcgct aaagaaacgt ttgtggtaga tggcaatgat
2881 gaaggagaat gtccctctca aatgcgtgct tggaattcct tccaagttga agagttcgga
2941 actgggctgg tgaaaaccaa agtgttcttg gacatatcca ctgctctcac cgcccaatgt
```

FIG. 49

```
3001 gacaccaaaa tgctgggcgc tgccataaag gggaataggt ctgttcatgg agatccaggt
3061 ctctggatgg tctcagctga aatcgatggg acatggcaga taatagagct cacattggca
3121 gagagcaggc gttgcacatg gccagactct cacaccgtgt ggggtaggaa tgtccaggag
3181 agtgagttga tactgccacc gtctttcgga ggaccgatga ccaacatgaa caagcgtaaa
3241 ggctacgcga cccaagtgggg aggaccatgg aaccatgttc cactacgagt agttttgaa
3301 gagtgtccgg gaaccactgt atctgttgaa ccaaactgca ccaggagatc ggattcagtg
3361 cgatccacaa ctgatagcgg caagattata accgactggt gttgtcgttc ctgtacaatg
3421 cctcccctaa cgtaccgaac ccccgatgga tgctggtatg caatggaaat caggcccaag
3481 aatgttaaag aggagagtct gatccgttcg catgtggcgg caggtgtgtt taaaggcatt
3541 gacgacgtgt cactggggct gttagtaatg ataattttcc tgcaggaagg tttgagaaga
3601 aagttaactg caacgtatat catgtgggct gctcttgtgg tcctcattgc aggaatccta
3661 ggggaactca cagtgaggga tgtgctcagg tatctcatcc tagtcggcac tgcattcgct
3721 gagagtaata atggaggaga tttaatacat ctggccctag tggcggtctt caagattagg
3781 ccggcattct tatttggatt cttgttcagg agtcagtggt cccccagaga aggtgtgttg
3841 ctggcatctg gagcgctgat gctgcagatt gcaagtgagt gcttgcacgc atcggcgatt
3901 atgcaggttg tcgattcctt gagcatgggg tggttgatga tcagagccat tgctgtacct
3961 ggtatgacct caaaagccat gccactgctg tgtgcctgca ttcctgcagt tacgagccta
4021 ctggcccact caaccagagc cggtataatc accatggccg gcatgtcgct tattgcagga
4081 agtaagggat catcagttaa aaaacacagt ccatacatgc ttgccctcgt ggtggcaggc
4141 ctcggagccc gtcccatagg aatgttggcg atggaagcct tctctcacct gaagggccgg
4201 agatcatggc cggctggtga gatgatgtca gccgttgggc tgacatgtgc gctagtggga
4261 gctatcagtg gcgcatcatc tcaggacttc gccggacctc tagcagcagc ggctctaatt
4321 attattgcat atgccattag tggacgctca gctgatgtat accttgagaa agccggtgag
4381 atatcctgga gtgaggacgc taaaatatcc ggatcaagcc cgcgcattga tgtgtgcgtt
4441 accgaaaatg gagatttcaa attgcgtcat gagagtgaag caacctggac ccggaattgt
4501 gtcttggctg cttgcttagt cgtagccgga gtgcacccac tggggattcc agtagcaggg
4561 ttgatgtggt ttggatatgt gaaatcaaac aagcggggga ctgtgttgtg ggacattccc
4621 tcaccacagg caacatcagc tccaacggtg gaagatggat gctaccgcgt tatgtcacgt
4681 agactgcttg gcagcactca gcttggtgtt gggatcatgc tagactctac atttcacaca
4741 atgtggcaca taacccgagg agcatctatt gttagtggtg aagggcgtct tgacccatat
4801 tgggctgacg ttaaggaaga cctggtctgt tacggagggc catggaaaat ccgcaacaca
4861 tgggatggac tctcagaagt tcagctgata gcggtggccc caaaagagaa tcccgtgaac
4921 gtccaaacaa tgccaggaaa gttcattgtg gcgaatggag gtgagatagg agccgttgtg
4981 ctcgactatc ctcctggaac ttctggttca cccatcgtgg atcagcaggg taatgtcata
5041 ggactgtatg gcaacggggt tatgatcaat gaccaaacgt atgcgagtgc cattgcgcaa
5101 gctccagctg aagttgcgcg caccccaacc tggttcactg atgatatgtt gcgaaaggga
5161 caattgcatg tgctagactt gcaccctgga gcgggaaaaa cccgcaaggt cctgcctgag
5221 attctcaaag cagcggtgga gaaacggcta cgcacgttgg tcctggcccc aaccagagtt
5281 gtggcaaagg aaatgcatga agcattacc gggctgccgg tacgctacca gacatcagca
5341 gtggcaccaa atggttctgg aggagaattg attgatgtca tgtgccatgc aacatacaca
5401 caccgccagc tgacaccggg acgggggtc aactaccagt tatacatagt ggatgaggca
5461 cattttacag atcccgcttc catcgcagct cgcggcatca ttgcgactag ggtgcgattg
5521 ggacatgccg cagcaatctt catgacggcc acaccccgg gaatgtcaaa cccattcccg
5581 gagtctaatg ctcacattga agacgaagag cgggaggtac ccaccaaagc ttggaacgct
5641 ggatatgagt ggataacaga ctatggggga aaaaccgtgt ggttcgtgcc ttccatccgg
5701 atggcgaaca ccatagctgc atgcttggta cgagcaggca agacagtcat tgtactgcac
5761 agtggctctt tcaatgaaga atatcaaaaa accaagtctg gcaattggga tttcgttgtg
5821 acgaccgaca tctcagaaat gggggccaat ttcaaagcct ctagggtcat agactctaga
5881 ctgtccataa aaccgatgtt ttcctacgct cccagtgagc gagtggttat tggctcacct
5941 agagcggttt ctccagccag cgcagcacag cgccgaggga gagtcgggag agaccctcgt
6001 caactgggcg accagtatat ctatggtgga ccagtaggag aagactcggc cgagttcgtt
```

FIG. 49 cont.

```
6061 cattggaagg aagcaaggat cctcatggat aatgtaactg tccctggggg cttgtatcca
6121 caattctacg aaccagaggg tggaatgtgt gacgccatgg atggagctca ccgactgacc
6181 gatgctaaga gagaagtgtt ccgagacctc atgaagaaag gggaacttcc tgtatggtta
6241 gcataccagg tggcccaggc tgggcatgcg tacactgaca gaacttggtg ctatggggg
6301 ccggcggatc atcaagtgta tgatgattgc ggccaaaccg tggattacag gtcccttaat
6361 ggagagaggc gtatgctacg tcccaagtgg cttgatcagc gcacctacaa cgacaaaaca
6421 tccttaaggc tcttcacgga atttgcagag ggacgccgcc gatattcgga actaatggac
6481 gtgtttggaa gaatgcccca acacatgttg gacaggacca tcttggctgc agacacgttt
6541 aaagatgtcc tgacagcaac accgggatct cgtgtgcacc gtttagcact ggacaattta
6601 cccgaagcta cagaaactat gatggtagtg ggaatcctga gtgtctcgac cctaggcgtt
6661 atgctatttc tgatgtcacc caagggcatg acccggatga cctgcggact tgtggtgatc
6721 atcctggcga cgtattttct atgggtgtca ggaatggccg gctaccagat agcagcaatg
6781 caactcatcg cgttcattct gtttgtggtc ttggtgccag agccagggtc acagagatca
6841 gtgcaagaca acaccatagc gataattctc atagtcatcc tgtcgttggc tgccatcata
6901 gccgccaatg aagcaggatt gctagagaag accaaaaagg atttcgcgtg gaagagggag
6961 agtcatgtgc tggtgactcc gagtccgtgg aacctggatt tctcaatgga tttgaggcca
7021 gccaccagct ggtcattgta tgtggtgatg gccaccatgt tagggccagt actggaacac
7081 gccattgtca ccaattatgc tagcgtctca cttactgcca tcacaaacca ggcaggaata
7141 ctgctgtcaa tggataaggg cactcctttc tggaatcttg actggagtgt tgtcctgttg
7201 tgcgtgggca gctggtcggg gatcaatggc actacactaa tggttgcttc cacaatgaca
7261 gttttgcatt ttgccatgat actacctggc attcgtgcca aagcggcgag agaagcacag
7321 aatcgaacag cagctggggt gtcaaagaac cctcttattg atgggttaaa caccataaac
7381 atccagccgt tgccggaaat ggacccccatg tacgaaagga aatggggct atggatgcta
7441 atcgctgttg ccggagccgc ggtggtttt gacaagagaa tgctccatta caccgagttc
7501 ggagtattgg gttcagctgc tgtgagtcct ctcattgaag gatacgcgtc tgctgtttgg
7561 aacacttccg tagcagccag tgtgtgcaac ctaatgcgag gccattacat ggcgggaatc
7621 ccaatggcat actctctgat cagaaatcta tccatgaaag gagttcctag gaggggatta
7681 caggccaccc atacccttgg tatggtttgg aaacacaaat taaacgccat ggacaaggcg
7741 gccttttaacg cataccggaa ggatggagtg acagaagtgg ataggggagcc agcacgtgaa
7801 gctatgaaga aaggagattt ggtgagcgga tgggcggtct ctcgagggtc agccaagctg
7861 cgatggatgc acgagcgtgg atacattccc ctacaaggag ttgtcattga cctcggatgt
7921 ggaagagggg ggtggagtta ctacgctgct gcacaacgcc gggtgaccgc tgtcaaaggg
7981 ctcacgaaag gcggaccagg gcatgaggag ccaatcaacg tccagtcata tggatggaac
8041 ttagtgacgt tccgtagtgg agtggatgtc tttcacaccg aagtccagcc ggctgacacc
8101 ctgttgtgcg acataggaga gtcttctgct gacccgctg tcgaaaaagc gcgcacagta
8161 caagtgttgg tgaactttga aagatggatt agagagtcgc ggtgtgagca tttttgttgc
8221 aaggtgcttg gtccctactc tcccgaagtg atggagcgct tagatcgttt aacaaagaca
8281 tatggaggag cggtaattcg caacccacta tccaggaact ccacgcatga gatgtactgg
8341 gtgtcaggag ctaagggtaa tccagtcaat gctataacag ccacctcacg tgtgctaatc
8401 gaacgcatgt acagaagact tggcaagagt tactgggaag aagatgtgaa tcttggtact
8461 gggacccgtg cagtttcatg tgccgcggag aagccagatc tagcaaaaat cggaaggcgc
8521 attgagttgc tgaagaagga gtataaagca tcatggttcg aggatccaga gcatcctac
8581 aagacatgga catccccatgg ttcctacgaa accaagacca caggcagctc gtctagtatg
8641 attaatggcg ttgtcaagga gatcactcac ccttgggata ccaacccaag ggttacaacc
8701 gtctgtatga ccgacaccac tccttttgga cagcagagag tattcaagga aaaggtagat
8761 accaaggcac gtgagccatc tcaagggacg cgggagatca tgagaatagt gagcaagtgg
8821 ctcacactat atattggtcg gagcaagcgc cctaggctgt gcacagcgga tgaattcata
8881 gccaaagtta atgctgatgc cgctctcggc acgatgttcg actcgcaggg aaactgggcg
8941 aacgccaaag aagctgtgcg cgacccacgg ttttggcagt tggtggccaa agagagggaa
9001 cttcacctgc gtggacagtg tgccacgtgt gtttacaaca tgatggggaa gcgagagaaa
9061 aagctgacag agtttgggaa gtcgaagggg agccgagcaa tttggttat gtggctagga
```

FIG. 49 cont.

9121 gctaggttct tggagtttga aagtttaggc ttcctaaacg aggatcattg gttgtcacgt
9181 gaaaactcag gaggtggagt tgagggcatt ggattgcaat accttgggta tgtgttgaaa
9241 gaaatggcac taattcccgg gggcaagatg tacgccgatg acaccgctgg gtgggacacc
9301 agaattacta acgctgacct tgaggatgag atggacatat tgggacttat ggacccgcat
9361 cacaaaaaac tggcaaaaaa tctgatggag ttggcgtaca acaacaaggt ggtcagagtg
9421 atgcgccctg gtaaaggggg aaaaacacta atggacatca ttagccgcaa ggaccagcgg
9481 ggaagtggac aagtggtcac ctacccactc aacacgtgga cgaatctcaa ggtccaattg
9541 atccgtatgg cagagtcaga gggagtgttg gacccaagg agatcgatgg aatcactgtc
9601 acgactcgga ataacctgga aaaatggctc actagccaag gggctgagcg tctaaagcgc
9661 attgcagcta gcggtgacga cgttgtggta aaaccagtgg atgagagatt cgccaatgct
9721 ctcacctatc taaacgacat ggccaaaatt aggaaggaca tcagtgagtg gaaaccatcc
9781 gcggggtggt tccactggga agaagtgcca ttctgctcac accattttca ccagttggtc
9841 ctcaaggatg ggcgcaccct agtggtccca tgccgtgacc aggatgaact aattggaagg
9901 gcaagagtgt cacctggtgc tggatggact atcagagaaa ctgcaggtct aagcaaggcc
9961 tatgcccaga tgtggcttct aatgcacttc caccggaggg acctcagaat ggcaggtttc
10021 gccatttgta gtgctgtccc cagtgattgg gtgcccacgg gaaggacatc gtggtcactg
10081 cacgctaaag gggagtggat gaccactgaa gacatgttag cagtttggaa cagagtgtgg
10141 attgaagaca atccccacat gtctaacaag actttagtgg gatcatggca agacatcccg
10201 taccagagga aatccctgga catccactgt ggctcaatga tagggcagcg gtctaggtca
10261 acatgggctg ctaacatacg aattagcatt ggacacgtgc gccgattgat tggaaccacg
10321 gaaaagtact tggattacat gcaggagcag gagcggttca agattgctga accaacccgt
10381 ctgggcaatg tgatctaagg atctacgaac gagaataagt agaagaacgg aacgacagag
10441 tcaggcctca aatgagccag cattaatgag agtaagtgct gctgcctgtg cctctcctta
10501 acacgtggta gcgccactcg tgtttcgtta cctaatagcg ctagagtcag acccaagtag
10561 gccagggcta tggttgtaag ccctgctgtc tgtggcagcc atccagtggt aatgcgtcgc
10621 accactaagg attaatagac gtatattggg agggactggt gaggagcagc aagctcgagc
10681 tgcatcaccc actggtacta tcggttagag gaaaccccct ccaaaatgta gagcatcata
10741 tcgacacctg ggaaagaccg gagatacctc ttgcttcaca gcactcaatc cacaaggcac
10801 agatcgccga ataattgtgg attggggatt gagaaacatc aagtatct

FIG. 49 cont.

SEQ ID NO:41    BgV genomic nucleotide sequence

```
   1 cgtaaaatcc gtacgcttgt tttggcacac tagtttgtga cataaggctt ttgtcgcgcg
  61 tattgggttt aactttttt cgagaaatcg agaggtaaga agaattgaaa gacattatgt
 121 ctaacccttc cgtcaggagg ggtgtcaatg tgatggcggc tcagaaaaaa cgagtcgccc
 181 aaaaaataaa atcaatgagg aagggaaccc agagcatcag caatggagtt aggggtttca
 241 tcctcttttt catatcccaa atcttctggg cacgtaagat cacgcccaga gtgaaaggat
 301 tgtggaaaaa actagacaaa tttcaggcaa tgaaggtttt gaaagggcta aggaacatca
 361 tcaatggatt gatgagatcg gtcgctggga aaaagaaacg ccgtggaggg aataccgtgc
 421 cattcttagt gatgatgatg gtagcaacaa catgggcctt aactctcagg aagattgaca
 481 acactattgt tctgaatgtc acccaaaatg acataggaa aacatttcct gtaaggggcg
 541 gtaattgttc cattaacatc aatgatgctg gatactggtg tcacaataca gtcgaatatg
 601 attgtgtcac catagctggt acggaagagc ctgacgacat tgattgctgg tgtgttggca
 661 ttgaaggagt gagagtgact tacgggaaat gttcaaagtc atcaccgcac gggaggagat
 721 ctcgtagagc agcagtcatt cccgcgcatg gtgggcaggg actatcaacc cataaagaga
 781 catggctatc cactgtagca ggggaaaggc aaatccaacg tatagaaaga tggatcattc
 841 gcaatcctct ttatgccgct gcaatggtga ctgtggcgta ttttctggga agtgacacca
 901 aacagaaagt gctgttagct gtgttaatgt tggcaattgg acctgcttac ggctctcact
 961 gcattggaat tgaacggcgt gactttgttc atggagttca gggaagcaca tgggtaaatc
1021 tagtgctgga ccagggatct tgcgtgacca tggtgactga aaacaagcca agtgtggatg
1081 tgtggctcaa ggaaatctct ttgagtcaac ccaccttggt taggagatat agccacacag
1141 caaaggtcca taaaacagaa atcaaagctg cttgtcccac aatgggagag gccaaacttg
1201 atactgaaca caatccgtcg tatgaatgca agcgcactta ttcggataga ggttggggaa
1261 acggttgtgg tctgttcgga aagggtagca tcattgcatg cgccgagttt tcctcaacgg
1321 gccatatgga tgtttatgaa attgacatga ccaagattga gtacatcgtg aactcgcaga
1381 ttcatggaac tgtgctcgtt gagaacaatt cccagcatgc agtagagtca aagttccagc
1441 caacaacagg aggagctgaa gtcacacatg cagggtatgg cacacttggc ttggactgtc
1501 atgtacaaac catgatggat ctgaacaact tctatctggc tgtcatggga tccgatgcat
1561 ggctagtgca caagcaatgg gtggaagatt tgacattacc ctggatggca ggtgaaactg
1621 gacactggaa agaaaagaaa tatctagttg aatttggtga accacatgcc acgaagatgg
1681 aagcccttgt tttaggttcc caggaggggg ctttgaggac tgcccttgct ggagctatgg
1741 tcgtggtgta ctcccaaaat gacaaaaaat tcactctgaa ggggggtcat gtgagttgta
1801 gagcaagatt gactgacctg acattgaaag gaacatcata tccaatgtgc aagggctccc
1861 tcaagttcac aaaagactcca gttgacaccg gacatggaac agcagtgatg catgtgcaag
1921 tgacgaaagg ggcaccatgc agaataggag tccaaatggc tgacaactca aatggaggaa
1981 agtcgttggg aagcatgatt acatcaaacc caatagtctc cactgatggt gaggagactc
2041 tggttgaagt ttctccccca tatggagaaa gttacatcat agtgggatca ggcgatggca
2101 agttggttta ccattggcac aagactggaa gcactattgg gagcctgttc tcagaaacca
2161 tgaaaggagc taagagattg gcaatcctag gtgatgacgc atgggacttc tcctcaacgg
2221 gaggggtctt agcctcagtt gggaaaatgc tgcatactgt gtttggacaa gctttccatg
2281 caatctttgg agggttgagt tggatttcaa aaataattct aggttgtgtt atgttgtgga
2341 taggtgtgaa ctcccgcaat ggcacattga gtgtcacctt gttgactgtt ggcggcattc
2401 tgttgttcat gacacttgga gttaacgctg agtacggttg ctcattggac ttccaaagga
2461 aagaactgaa gtgcggcgat ggagttttcg tgttcaatga tgccaatgat tggttgacca
2521 agtacagata tcatcctgaa gacccacgaa cattggcttc tctggtcaag gcttcatata
2581 aggccggacg gtgtgggctt ggatcagttg acaacatgga acataagatg tgggtgtccc
2641 tggaaaatga gttgaatgcc atctttgagg aaaaccaaga aaatatctca gtggtagtga
2701 aggagagtaa tggaatatac cccaaaggaa attatccatt cactggcact ccagaaaagc
2761 tgaaatatgg atggaaaaca tggggaaga aattggtatt tgccccggtt ttgagtaaca
2821 acaccttgt aatagatgga actcccgatg attgtcctta cagcaacaga gtttggaatt
2881 catttgagat tgatgagttc ggagcaggtt tgactcatac caggggtgttt ttgaaacaaa
2941 gactggaaag aaaagaagag tgtgacaatg cacttttagg agctgcagcc aaaggggacg
```

FIG. 50

```
3001 tggcagtcca tggggatccc aacttctgga tggcctcaaa caaaactgga gaagtgtggc
3061 agatcaatga attaatgtca ctaaacctca agcactgcac atgggcccttg tctcatacgt
3121 tgcatggcaa tggagttctg gaatcagaca tgttcgttcc gaaaagcatt ggaggaccgg
3181 ttagtcacca caacttcatt aaaggctaca aatctcaggt aaatggacct tgggcatcag
3241 tgcctctaga aatgcatcgg agagagtgcc ctgacacagt ggttcaaata gatcagaact
3301 gcagcgggag aggcaagtcc acacggagca ctacaaagga agggaaaata atccgggatt
3361 ggtgttgtcg aaactgcacg ctgcccccctg ttagctttga tggtcctgat ggatgctggt
3421 atgctatgga gattagaccg cagaagatga atgaaaaaca tttggtcact tcatgggtaa
3481 gtgccggtga cgggatggaa aatggtaaca ttggattggt ggctctcttt gtgtgctttg
3541 acatgttctt gaagaacaag aacacccgaa agattagctt ggttggagcc ttgtgtctat
3601 tgggcgcaat gatccttggg aatgttggat ttgttgatct aataaaattc atgattgtgg
3661 ttggtgaaca tttccgctcc ttcaaccatg gaggtgacgt ctcctacttg gtcctgaccg
3721 ctgtctttga catcaggcca gccctgctct gcggctttgt gctgcgcaag aaatggagtc
3781 ctagtgagag agtagtcatg gccattggaa tgatgctcct gcaaacggtg tgtggggatt
3841 ggactcagac atcttggtgg gaatggctgg atgctgttgg attggggctc ttgatcctca
3901 atgcagtagc tttacaaaga tggaaaccgg ccatttttggt cttgctgaca atgttgactc
3961 cgctgaatat gcgagtaatt caaggtgctg caggggggagt gtgtggcgtt atggtggcca
4021 tgtctttgtg gaaaacagaa ggaagaagtc tccgtaagag ttacctgcca gtcattggct
4081 atgttgcttc ggcttttgga tgggggtatt catggatcat ggcagtgtac atcatgtggg
4141 caacccatgt gtcaaggaga tcttggcctg taggagagct ggcagcagca attggacttt
4201 tgggagctgc aatgggaatg gcatccacaa aggatggagc catggtcatg ccaatagctg
4261 tgctcggatt aatcatggtg atcataggaa tgacaggcaa atgcgatgga atggagattc
4321 gcaaagttgg gtgtgtctcg tgggaagact ccgctgagat cagtggttca agctccaggt
4381 atgacgtggc tcttagtgat ggcggagaat tccagctgtt agagaattcg cggccccccct
4441 ggaatcacat cattttcctc accctgggaa tgctggcgtc agcagtgcat ccaatagtac
4501 tgggtgtggt catacttgcc tggggggtggt ttgcaggcaa aagccagcgc agtggagttt
4561 tgtgggacgt gcctgttgct ccaaaagttg aggaccatgg accccttgag gatggaattt
4621 acaccatttt ccagaatgga ttgtttggga gctcccaggc tggagtagga gtggctcagg
4681 gaggcgtgtt tcacactatg tggcacgtta ctcgtggagg aatcctgctg cacaaaggta
4741 aaagactcac ccctggttgg gctagtgtga aaagtgacct catttcgtat ggaggtaaat
4801 ggagacttga tggaagttgg gatggagtcg aggaagttca gttgattgct gtccctccca
4861 ggaaaaatcc tatcaatgtt caaactaagc ccagcatttt caaattaaag agtggagagg
4921 agatgggagc catagctttg gattaccta gtggaacttc aggatcaccc attgtcaaca
4981 gagctggagt cgttgtgggg ttgtatggaa atggaattgt gctcaatcag ggtggttatg
5041 tgtcagctat tagccaagca gctgtggaag aggtcagtag agatgagcta cccggaattg
5101 aaggctacct gagaaagggg caactcaccg ttctggattt tcacccaggg gcaggaaaga
5161 cacgtaactt cctgcccaa atcttgaagg catgcaggac ccgcaagttg cgaacactag
5221 tgctggcccc aaccagagtg gttctgagcg aaatgaagga agctctgaat gatcacgatg
5281 tcaagtacca cacacaagct ttctcatctg ccagttcagg acgtgaactg attgacgcta
5341 tgtgccatgc aacattggca tatagactat tggaaagcac tagggtgata aactgggagg
5401 ttgtgataat ggatgaggct cactacatgg atccagccag cattgctgtg aggggttggg
5461 ctgcccatag agctagagct catgaatgtg caacaatatt catgtcagcg actccccag
5521 ggactgcaaa tgaatttcct gaatcaaatg gaggcattga ggacatccgc aaggacatcc
5581 ccagtgaggc ttgaacaaa ggtcatgagt ggatcctaga ggatagaagg ccaacggtgt
5641 ggttcctgcc ctctataagg agcgcaaata acattgctgc atgtttgagg aaagccaaca
5701 gaacggttgt tgtgttaaac agacagacct ttgaaagtgt gtaccccact atcaagacaa
5761 agaaaccgga cttcatccta gccacagaca ttgctgagat ggggggcaaat cttcatgtgg
5821 aaagggtaat tgactgccga actgctttca gccagtgct cagtgaggat caggaacggg
5881 taacactgaa agggccaatg gaatatcag cttctgcggc agctcagcga agaggccgtg
5941 tggggagaga tccatccaga gagtctgaca catattacta tggagaggac acctcagagg
6001 acaatgacca tttggtgtgc tggactgagg cgtctatgat tctggataac atggaaatta
```

FIG. 50 cont.

```
6061 aaggggggaat ggtggctccg ctgtacagcg tggaagccac aaagaccaaa atgacgccag
6121 gtgagtgtag gctaagagat gatcaaagga aaacttttag agcattaata aagaaacatg
6181 agctgcctgt gtgggtctca tggaaggtgg ccaaagcagg aatcactcca gatgatagga
6241 agtggtgttt tgatggagag gaggacaaca ccgtgcttaa tgacatgggg gagaaggtca
6301 tgggaagaag cccaggaggt gcaaagaaag ctttgtgccc taggtggtca gacgcaaggc
6361 tgactagtga caatgcttcc ctcatgaact tcctggcatt tgccgagggg aggagatcat
6421 acatgaggat cgttgacgct ctcatcatgg tgcccctat gctgaaagaa aaggtggtgg
6481 atgcagcgga caccttagca ctactactgc gttccgagga gggcagcagg gcctacaaac
6541 ttgctcagga gagcgctcca gaagcgatca acacactcat catggtaacc ttcctggttc
6601 tgctatcagc aggactggtt ctgatgctca tgtggccaaa agggattagc aagatgtcat
6661 tgggcatgct caccatgagc gttgcgggat accttctttt ggaaggaggg ctcacccaag
6721 tgcaggttgc aggaatattg ctggtgtttt tcatcttgat ggtggttcta atccctgatg
6781 atggctccca gaggtcaatc aacgacaaca agctggctta catgatgaca ggaattatcc
6841 ttcttgttgg agctgttgct gctaatgaga tgggatggct tgaaaaaacg aaacaggatt
6901 tgtttgggaa aagggaagaa atgccgggat ggaactggga tttgggactt gacctaagac
6961 ctggagcagc ctggaccact tatgtggctc tggcgactgt ccttggccca gtgatagacc
7021 attggataca agtggaatat ggaagcgcta gtttgactgg catagccaat tcagcaggca
7081 tttccgcatt tctggacaag ggggttcctt tcatgaaggt caacatggca gtggtggttc
7141 tgtttgtgag cgcatggaat agctattcca tgctggccat catggagggt tgcctgatgg
7201 caggcattca tttttgcctg ttaatccctg ggctgaaggc aagagcaatg aagaaggccc
7261 aaaagaggat ctatcatggt ctatctaaga atccagtagt tgatggcaca cccactgtgg
7321 atattgaaga agctgaagaa actccagtac tgtatgagaa gaaagtggct ttggcactgc
7381 tgggagttgt ggctgcgctc aatggaattg tggtcagaac acctttctcc atggctgaat
7441 caattgtgct ggggagtgcc ttggtgggtc cttttattga gggtaacacg tctccacttt
7501 ggaacgcccc tatcgcggtt gcgttcgctg gtctaatgcg gggacattat agcagcatga
7561 taggattggc ctacaattttt tggatattgc aaaaccccaa aagaggaggt ggtgagacca
7621 tgacccttgg ccaggtgtgg aaaaagagac tgaacatgct tgacaagaag gagtttgcaa
7681 aatacaagat ttcagacatt catgaggtgg accgtaggca agcacgtacc attctggacg
7741 caggcatcac caacgttgga gtcagcgtgt caagaggaac atccaagctg aagtggctga
7801 cagacagagg gtactttaag ccagaaggta gggttgtgga tctcgggtgt ggccgtggag
7861 gttggtcata cttggctgct gcagcaagag aaaccctgga agtgaaagct tacactctag
7921 gtgtgtcagg gcatgagcga ccaattcaaa tccaaagcct gggatggaat gttatcaagt
7981 ttaaggacag agttgatgtg cacagacttc caatcgccca atgtgacaca gtgatgtgcg
8041 acattggaga gtcttccagc tcttgggaac aggagcgaga gagaaccctg agggtaattg
8101 acctgatgga gaactgggtg ccaagagca gacccaaata ctgcttcaag gttttggctc
8161 cctactcctc agaagtgatt gagcgtctgg aactgtttca agaagattt ggtggcggga
8221 taatcaggggt tccactctca cgcaactcaa cccatgagat gtactacact agtgaggtca
8281 ccaataacat tgtgcacatg gtgaactgcg tctcaagatt gctgctccgg agaatgacca
8341 accccagtgg aatagccatc ttagagccag atgtggtttt tccaacagga acacgcaatg
8401 tcaaggggga cttgggcccc ttggacatgg agaagatcaa gatgcgtgta tccaagttaa
8461 aaaaggagaa cttggacaca tggtggcatg atgaaaatca tccatacagg acctggcatt
8521 accttggaag ctacgttgct aaacagagtg gcagcgcagc cactatggtc aatggaatag
8581 tcaagctact gagcatgcca tgggatagga ttgaggatgt tactgccttg gccatgacag
8641 acacaacacc atatggacag caacgtgtgt ttaaggaaaa ggttgacact agggctccac
8701 cccctcctcc agggactagg aaaatcatga gcattaccaa cacatggctc tttgatttcc
8761 ttggccgaag caaacaacct agactgtgca ccaaagcaga gtttatagca aaagtcagat
8821 cacacgctgc cataggcaac atgttggagg agcaggaagg ctggaaaaat gcagctgagg
8881 cagtgaatga tccaagattt tgggaattgg ttagtgaaga gagggagcta cacttacaag
8941 gaaaatgctc cacatgcatc tacaacatga tgggaaaaag agagaagaa cccgctgaat
9001 tcggacgtgc caagggaagc agagccatat ggtacatgtg gctcggagct aggttccttg
9061 aatttgaggc cctgggtttc ctcaatgaag atcattggtt ctccagagac aactccaagg
```

FIG. 50 cont.

```
9121 gtggtgttga ggggatgggc ttgcagtacc taggctatgt tgtggaagat gtgtggaaga
9181 aggggaatgg aatcatgtat gcggatgaca cagctggatg ggacactagg ataacagagg
9241 ctgatttgga ggatgaacaa tacctgcttg aaaagatgag tggcactcac aagaaactgg
9301 cttgggctat tacagagttg acctacaaga acaaggtcgt caaggtccct agacctggac
9361 ctggaggaaa gattctgatg gatgtgattg ccaggaggga ccaaagaggt tctgggcagg
9421 ttgtcaccta tccctcaac actggaacaa atctcaagac acagttaata aggatggctg
9481 aaggcgaggg cataatcacc ccagaggaca cactccaact cagtcacaag aatgagaaaa
9541 atttgaggga atggttgtgc acccatggtg ctgaaagact tggtagaatg gctgttagtg
9601 gtgatgattg cattgttgcg ccaattgatg agaggtttgg caacgcccta agtcatctca
9661 atgccatgtc aaagattaga aaggacattg atgattggga gcccagcaag ccttggatga
9721 aatgggagga ggtgccattc tgctcccacc atttccacca tttgctactg aaggatggca
9781 gaagaattat tgttccatgc cgaaaccaag atgagctgat tggaagggcc cgagtgtcac
9841 caggaaatgg atggatgatc aaagaaactg catgccacag caagtccat ggtcagatgt
9901 ggctcctcat gtatttccat aggagggatc tgagattgat ggctaacgca atatcatcat
9961 gcgttcctat caattgggtg ccaactggaa gaactacatg gtcacttcac gctggaggag
10021 agtggatgac ctccgaggac atgctggaag tgtggaacag agtttggatt ttggacaatc
10081 ctcatatgag tgacaagtca gtaatcctag agtggagaga tgttccatat ctggcaaaga
10141 gtgatgatat caggtgtgga tcattgatag ggacatcaca gagagcctgc tgggcagcta
10201 acatccgttc tgtggttgag aaaatcaggc atttggtggg agatgagaag tacaaagact
10261 acctgcactc catggacaga tatgccctgg aacactccga aattggctgc ttgatataaa
10321 ttaaagcact ccattaaacc aaccaaacac tccttcatca aacaacactc catatttaaa
10381 gtgtcaggcc gggaaaccgc catggctaag ctctgaggcc atgcagtctg ggagagcagc
10441 acattcttgc ccacagttgt gcttaattac attttgggga gcctcccttt gtcatgcgat
10501 gcatggtggc aaagcgacga ggactagtgg ttagaggaga ccctccctgg gctatgcatc
10561 aagtcggacc gtttctacgg gaagctgtaa accgtactgt ccgtgacagc attccgaaag
10621 gttgggcgaa gctgtaagcc tgtaaaactt tggagcctcc gctctgcgac ccgtgtaagc
10681 agagtcgatg gggactagtg gttagaggag accctccaca gcaaacaaca cacacggatc
10741 acattgacac cagggataga ccggagattc ttcttgcctc tcgacagctt taggcaccga
10801 ttgccaaact acgaagctgt cgagaaacga caagaatct
```

FIG. 50 cont.

SEQ ID NO:42    KRBV genomic nucleotide sequence

```
   1 acaagccamg gccgccatga gtccgatgat aaagcatgct acaacatgct tgttgttcct
  61 agttctttgt cgagtctcct tgcgtacctt acgtcccagt gatcgcaagt tgcgtaccaa
 121 ctcattccaa atggtgacca ttgcgacaac cagttttaac aaagtctcgt tcaaatctcc
 181 agaaaccata ttgagtgcyc ggcgaagaga wgatgttttt aaaaaacctg cctgtgtttt
 241 cttggttatt ttacctgttt tcactcactt ggttggtttg tttgaaatcc atttctttta
 301 actatcgayt ttacgttrcg tttngactat gcargtcaag aaaataaaga tgcgtggtgg
 361 aggaggtgga aagctcggca ttaaagggat aaaaacatcw tccctgcgtc gggcactcaa
 421 tatggtctct ggagatttga atgagaccct gctgaaactg gtcatcgcta tgatcgccat
 481 ttggaatgag ttactacgta acttgcgrtc attggggcgt agggttcgca aggagactcg
 541 acaaagaact ggaaacaaca agcatgttgt agcatgcttt atcatyggac taatggcggc
 601 cttggcttgc gccaagacca tgaatggaat aatggacaag ggtgagcacg tttggaaagc
 661 tgactggaat gttgacttta ccaatgtgaa gctccccaag gacttctgcg gatctggaat
 721 acacgtggag aagatgtgtc ctcaggttga ttctttgcaa gatgcaacaa tcgactgcgc
 781 aggaagacat gaccaatttc tcctgtccta tacacgatgt gcggctaaga atcgtgtcaa
 841 acgtggtgaa cccggagtag tggaaccgaa agtcacgaac atatggacca taacgttcaa
 901 tgatgagttg aacagcatca ttgaacgtgt gagcgggatg ctgaagaaca atcgattgat
 961 ggcaacagca gtcatttgct tagttggggc tttcaagaaa tggcctacat ggctcgtcgt
1021 gcttttggtt ttactgcctt ggactgtcgt gcaggcatca ctggccgatc ctttcttaat
1081 tctgccgaag ggtgatggtt tggtaaaaac tagattatac ccaggacaga tttcatcaat
1141 ttccacacac gttggggtac tggacatctc ttatatggct gtggacattg aggaggggcg
1201 actcgttgaa aggttgatgt cacattgcga agtaaatgga acttactcac aggattgttg
1261 cgctttggga tgcaacttgg acttatctaa gttaaatgag cggaacaggg cctgtcaaac
1321 ggctacctac aatcgcgggt gggctacggg atgtccagtt tttggactgg gcagtgtggc
1381 cacatgcgtt gaggtcgcgt gcagcgatag tgtggaggtg tccgaactga caagccagaa
1441 catccggatt cctctatctc tacgtttgca gcatgaagag ctgaatgtga ccatgacaac
1501 agaggcgcca gttacttcaa agttctcaca tcacggggtg gtatccatct cttgtcaaat
1561 tggcaatcct gggttcttgg cacagcagta cgtgctgagc aatgggaagc ataaagcaat
1621 gtttcccatc agtgcggtat caggttggcc tggaatccgt gagattggtg gacagtacag
1681 gaacgtggat ggctccgtca agtgggggca cgttgaagcg aatgagatta aggtggccgc
1741 tgtatatagt gacagcatcc aatgggaaac tggaatcccg ataaagacag gtattagaga
1801 cccactgtat ttgtactgtg aagtgtcgct aactgacttg actttcaaga aaataagagc
1861 atgtgaatcg cctgttgaag tttcgttcat ggcaggacct acgggtttgg atggtcgrct
1921 agaaattggg ttgcttgagc aagtcaacaa aacatgctca ataacaggga gctgtgaagg
1981 ttgtaccctta ccgcacccaa ccagtgtcat ttcgacttct gacaagaaag gccacatgca
2041 cgtagaatgt cgcacgggga catttacggc aatattcgga aagcaaaaat ttctttcac
2101 ctgtcrracw agttacctca gaactatttg ggctacgact gcccaggcga ttggaaatta
2161 taggaaattc ggactggatg cctcaggagg accattttg gacttatgga ataagatagg
2221 tccaaatttc tcccgtttgg aggttgttgg aatccttgtt gtggcagcct tgttaattga
2281 caaaagactc ttacttctcc tggctatttt tggatacgtc acatacgtgc gagctgatgt
2341 gggttgtggt attgacctat ccagaaaaac tttttcatgt ggtgagggca tattcttgtg
2401 gaacgacctt tcatcgcaga cttgggctta tggagttgag gtcgtagaaa ccaaactgct
2461 ggaagcctac attagtcaga tgctgaaaga gaggacgaaa gtctgcctac tgtgtgagga
2521 catcttgcaa tgttcagcag cccgacgctt agcagcggtt gtggctaaaa gcaatccaga
2581 tgtctattac aatgattcat tgtcatacgg agctgttttt cccatgcgaa agaaaagcca
2641 aataacgata acagctgacg gccggtcggc tgtggttgcc tccttcgtaa tagaaggaat
2701 gataaccaac tcagctcttg gcaaattaca atggaacgtg tggaatcctc ggccaacagc
2761 ggaggctatg gacgacaaag tgatccgagt tttaacaaca gggtctaaca taacgtctgt
2821 atgcagtaaa gccattggtt ttgagtacgt tttcgaacgg tttactagga agatgtatgg
2881 ctcaagccgtc ctagtgaaaa gcacttcaca catttcccac acttgcccta cttatttggc
2941 tggtgctgcc atcaaaaaca acagaacaat tcatacggat gggttcttgt ggatggatag
```

FIG. 51

```
3001 tgcactgcag gcaaatggta cataccgact cagttcacta tcagtgctcc agagtcatga
3061 gtgtgagtgg ccggtgaccc ataccatcaa cccaacggac ccaaaggatc gctctttgtt
3121 catgccagcg aggtttggag ctcctgcttc acgagctaat catatgccag gatatcttac
3181 acagcgtacc attccatggg ataaggcacc cataaagctg atttatggag tagcacctgg
3241 aactacaatt aaagaatttc caacgtgtga cgatcgcggc gatgctctgc ccatccttc
3301 acaagaaact cgtgagtggt gttgcaaaac ttgtttaagc aaagggactc cgccgtttca
3361 cctagtcgta gatgggtctt tgtactaccc agaagaggtc agaccgatac ccataccaac
3421 gaagatcacg gaatctgtag ctcaacccgt aacgcctcca cctgtcatga aaacgatggg
3481 ggcagaagcg actcaggatt ttcagatggg gccaggggaa gggacatttg ctcgcctggc
3541 cctcctggca ttggccttac atctaatatc acaaaatacg cgtcatggat ggatcacccg
3601 ggtcgcgtgt gcagccatgc ttttctccgt gactggccty ccctatcacc tccggtattg
3661 gtggccggtt attggtttct cggttttaaa gaatgcgtcg ggacagtctt tgctagtgtc
3721 gctgtggttg gcgttacaca ctactggtgg gcacctcgtt tgtttaggtt cactcctgcg
3781 gcaaacaaga tggtgctacc ggctccaatc cctaatgatg ctggtggcgt ccctatctct
3841 gtaccggttc cgggggataa cttggctcat gaacatcata gacctagtgg ctccgttgat
3901 atcaatatct tttctctaca aagcaagaac cctacttcta ggggaagttg tcttaattgg
3961 gagcgggtta gctctttcat ggggaaacgc cctcctaact ctaggagtat tatttgggac
4021 ccacatggtg attgcctcgc tgagaaaaac agcaaacgca ttcgagccag gactacgtgc
4081 caacatctca ttgtgcaact tcccacaaca ggttgtgagg gacatgtgga ctgtattaaa
4141 gaactggcgc agagcacccg caccttggcg gagctctggg agaacacata tctcacagct
4201 agcggtttat ctcctgctgt tgggcctcgc ttatgcgttc cacctttga acttggaagt
4261 tctagccgga gcctgcgtct taatcggatt cctctggatt ttgatgggag aaatgctgac
4321 ctcgggagaa ctagaactgc ggagggtgtc ggctctggag attcctcagg gccttgaaaa
4381 aatygtcata gatcgagact tccaaagcga atatgggcgg ttcacagacg cgggtgtcaa
4441 attggacaac ttcaatgacg aaacgaatgt caagttcagc ttactttccc taggatttgt
4501 ggcggctctc atcactgtaa acccagtgtg tggattgaca atcggattcc taatatggat
4561 cttcacatca tgccctctcg caaaagactt ggccatggca gcaagctgct tccgctcgga
4621 tgatggtttt gctgtattaa taccaggggt gaaggaggtg gctattggga caagattctt
4681 cacgttatcc gatggcgttt actccgtttg cagacgatca tggaatggac tcagtcacgt
4741 aggagctggt gtggcgaaaa acaatgtctt ccacactctt taccatgtga caagaggtga
4801 ggcgatttca tgggctagtg aaaaagtagg acctacgagt gggtgtgctt tgagagacgt
4861 tgtaacatat ggtggagatt ggcagttccc gctggtcacg gaagatgaag cggtcgtgaa
4921 gattgtcaat tccgacctaa ctgtctctca ttgctacacc aatgtcctca gtctcaatgt
4981 tcaaggtgaa gagtacggag tgatagggca cgatttcatg gaaggttctt caggttcacc
5041 ggttttttct tcgcagggggg aaataatggg attgtatggc tatggattct atgaccgtga
5101 gaaccggtac aactctctga tttcatacat gaagatggaa aaagaagagg agaaagtgaa
5161 gacgacggaa gagcaaccaa caatgagggg gactaggacg ttcatcaact ggcatccagg
5221 gaaagggaag acccgtaagg tgattctcga agaagctgtc agacatgtga acgaaaacaa
5281 acgcctactc attttgacac ccaccagagt agtgatgacg gaagttctac aagctttgac
5341 tggaaatttg cccttcggag ttcgtgttgg gaagcacttg agtaaaagca gatcatttca
5401 gattactgtc gcttgtcatg ccaccctrac aagtcatgtg cttcaacatg gattgaagat
5461 yaacttctct actgtcatca tggatgagtg ccactttctg gaccccctgt caatagctgc
5521 acgcggtatc atggagcata tgcattcgaa ggggggctgct ctcatgtatc tcagtgctac
5581 tccgcccggg aaagctccac aagctggttc aaattaccct attatagacg taccatctat
5641 gcctagggat gttgatagga attttgtgac atcccaagct ggggrcaaaa ccatagtctt
5701 tgttccaacg attgctcaag cacagaaact gtccgatcaa attccaggct cagttgtttt
5761 atcacgcgaa actttcgatg taaacatgtc aaaagcggct aacccggaaa caaaagtggt
5821 tatctcaaca gagatcagcg aaatgggggc caatctcggg gtagatactg tcattgacac
5881 tcgactgtgc gttagaccag ttgttgatgg acgtttcaaa gttcggttgg tgaaagtccc
5941 aataactcat gcatctgctg tgcaaaggcg tggtcgaact ggacggaggc agccagggcg
6001 gtacatcttt gacgacaagg ttgaaccgtc tgacgagtgc tcacattggg tatgttggag
```

FIG. 51 cont.

6061 ggaggctcag atgctcctgg atcagcttga tatgacaccg atgccggagg aagcggagaa
6121 ttttgaccca ccaggccact ataaactcct ttcggaccag cttaaacagt tcatggagct
6181 gctcacgacg gagatgccta tttggctagc gtggaattgg gccaacgcga gttcctctcg
6241 acacacggtg atttttggag gatctgaagt cactgacaag acgaccoctg ttatcactac
6301 accatcaggg aaacaactat ataatccaca atttgtcgac gaccgctttg aggcagatga
6361 tctaactaag tttcacgcca cgatccaaaa atatctgagg atgcgagctc acattaactg
6421 ggagggatta gcccagggct tgtggcacgt cgtgacaaag agcgactcat ccatgtttaa
6481 ggtcgcgttt cagaacacaa tggagcggtt acatgaccta tcgcgctggg atgacgactc
6541 cctccggaca agtgatatga ccgaatcagt tggcacgtgg attatcgtca tgcttacagc
6601 ygtgtcgaca ttcatcatct cactcttaat ttttgcttgc tgtcgrtgtt gcaaatcgtc
6661 caagactact aggtcccagg aagttgttta cactrcaaca gtcgcggaac gcaatgtcag
6721 tgggctttgg agtagcatga cagttccagt gttggggtgg gttgctggaa ttccaggacc
6781 tattctcttc gttgtggcag tgtgtttagg tcttgtttgc gccttcatgt gcaacagcgc
6841 gacgcgaagc tacgtggacc acaccctatc gtggtgggtt atggttctat catgcattgt
6901 ggcaggccta gtcgccttcg aactcgactt gatgcctcgt actttcgcta tcctttcaag
6961 agtggctgct accggggcta gatttgacac tggaccaagc gtggaaccct tcatcgttac
7021 tgggagacat gtaactgttg aactctgggt rgtcatcatg gcgatgtatt tgacagcctt
7081 gatcattgcc cccatcttga agtcatacat ccaggggaag tcgatagctg ctgtcttcgc
7141 gaatgaacca gttgcctccg cgtacatagg aggaatgagg ctgacaacca tctacgcgtt
7201 gcaagcaacg atttgtgtag gtcttttcta cttccacgca aatctcccat cttgtgttgt
7261 tgccagtgtt gcttcgttct tgtttctaat ggtatttgct tttgacgtaa agtatgcctt
7321 ctcccggct gtcgtccgag ctttggaagc caagaataac aaacgcgaca cggatcgacc
7381 atccctagaa mgagacgaag aaacgaaggg acgccaactg tactacacac tatctgttgt
7441 catggttgca ctatgggtga ccatagtacg agaccaatta accttcgtca cagctgccgg
7501 tgtagggttg catgccttga tgtgtttaat cgttccagat catccattcc atcggaatat
7561 caaccagggg attgtgacaa tgttgttcgg gttcttagtg gaacctgtra agtggacatt
7621 cattgtcggg ttcttcctct ggggagtgat gcactacaca agcccaaact cgtaccggtc
7681 atcaaacaag ggggacgcca tgaacgtggg aatgaagtgg aagaggctgc tcaattcctt
7741 gaatcagaaa cagtttgacg cgtacaaatc tcgctcggtt gatgagactc caagaggtga
7801 ctatgtgtca agaggaggcc tcaagatgcg tgagataatg gaggtgcacg gttgggaacc
7861 aaatggaaaa gtggttgatc ttggatgcgg acggggagga tggagccagc atttggcgat
7921 ggatcgtcgg gtcacggaga tcaaaggtta cacccttggc ggcagcaatc gggaaaaccc
7981 cgaggtgttc atgacctatg gctacaactt gtgcacgcta aaacccatgg ttgatgtata
8041 taagttggag ccatttgtca cgaacactgt catttgtgac ataggcgaga gtgatccgtc
8101 ggccgtggtg gaaaaaacac gcacgctcaa ggtcctcacc ctgttggaga attggttgac
8161 agtctcaaaa gaagccaatt tcgtttgcaa ggttctttca ccgtatcaca ctgaagtgct
8221 gaaaaaactg gaaactcttc agcatgtgta tgggggacgc cttgtcagac tgcgcttgag
8281 taggaattct actgcggaga tgtattacat atccgggcca cgatcgaaca tggtgaaggc
8341 ggtgtatgct acactgagag ctctaacggg ccgattgtca ttgtatgaca cgcctttga
8401 aagcctgccc cctacattgc cgacagggac acgtgccgat ccgaaggcca aagccaaagc
8461 tgctgatttt tcattattgg ccaggcgcat ccagaaactt cagcaggaaa atcaacacac
8521 ttggttccat gataaagaga atccttacac atctttctcc tatcatggtt cttttgtcac
8581 tgacgctgtg tctggtggtg gacaaacagt caatcccatc attagaaggt tgatgtggcc
8641 ttgggagcaa gtggccaaag ttactggctt tatgatgact gacgtgtcca cttatgccca
8701 gcaaaaagtc cttcgrgaga aggtggacac atatgttgaa gaaccagacc accgtatgaa
8761 gcagatcaac agacaactag ctctattcat cgcggacttg tacaagaagc aaggattgag
8821 accacgcatc ctgtcaaaac aagattttgt ggctaacgta cgctcagatg cagctgttgg
8881 tggatgggct agtgacatgc catgggcaga cgttgaaggg gccataacgg atccagtttt
8941 ctgggatatg gtggaccgtg aacgtcagct acatctcggt ggtgattgtg aactatgtgt
9001 ctacaacacc atgggcaaga aagagaagaa accggctgtg ttgggcaaag ccaagggatc
9061 acgcacgata tggtatatgt ggctcgggag tcgttttctt gagtatgaag ctctgggatt

```
9121 tctgaaccaa gaccattggg tctcgagaga ccacttacca tgtggcgttg gtggtgtagg
9181 tgtgaattac tttggcaact acttaaagga gatcgcagag aaaggcaaat ggttaattgc
9241 cgatgatgtg gcgggatggg atacccggat aacagaatca gacattgagg acgaacgttc
9301 tctgttgttg tccytggtta aagatccgta tcacaaagct ctgatggact ccatattcac
9361 catggcttat cggaacattg tagccctctt ccccaggaat cataagaaat tggaagtgg
9421 cacggtgatg gacgtagttt cgagaacaga tcagcgtgga tcaggacaag ttgtgactta
9481 tgccctaaac accatcacga atgcgaaagt tcagctggga cgctcgcttg aagctgcagg
9541 gttgctggaa gccgatgata ggactataca agtttggctt cgcaatcatg gagaggaaac
9601 tttaagagga atgaccgtcg ctggtgatga tgtggtggtt gctaccaatt cggactcctt
9661 ccacacttcg cttcattacc tgaaccgaaa tagcaaaatt cgcaaggaca ttggaccatt
9721 ggagccatca cgccggtgtg ayaactggga ggaagttgaa ttctgttctc accattttca
9781 tccaatcacg ttacaagatg ggcgagttct aatagtgcca tgtcgtgagc agaatgaaat
9841 catcgggcgt tctaggctcc aaaagggcgg cattgtcagt gagagtgagg gagcttgctt
9901 ggcgaaggct cacggacaga tgtgggcact gtatttcttc catagacgtg acatgcgttt
9961 agcttacgcc gccatcacag cgtgtgtgcc gtcgcattgg ttcccgaaag ggaggacttc
10021 ttggtcagtg caccaaaaac atgaatggat gacaactgtt gacatgcttg aggtgtggaa
10081 caatgtctgg atacacgaca acccttggat gacgaacaaa gaaccagtct cgtcatggag
10141 catggtacca tatctcccta agaaacagga cattgcatgt ggcagtcgga ttggaactac
10201 tgaccgcaca ctatgggcga aggaaatgcc ggagcttgtc tccaaattac gacgtgtctt
10261 ggacaaaacac gaaggaccac aacaatatac tgatggtttg gctatttggg gccgatacca
10321 acagtccccc ggaaacacgg ctgacatcta cgtgtaaagt ggtcttaggg cagcacatta
10381 gtatagctgg gaaagtaggg ttacaatgct tcttgtatg caactgatga ggtgagttgc
10441 gacacctccc tgtgagcaac ctgttcaaac ttttgaagaa gtttgaccaa acccggaaat
10501 ygacaaagtc gttgaagtac agcacaacga ttcacttaaa aggctgtaca tagagcaaaa
10561 tccataacaa catcatggtc attctcttac catcaggaga gtggatgaaa tgagctgctc
10621 actcatttca caatggcatt ttagaaataa tttgaccatt catattttac cattatcaaa
10681 atggactcca ttgcttgcac aaccaatcct aaactggatg gaacgcgagt aatggtggca
10741 aaggagttgg gagcactcct catatgacaa gggcaacaca rrctatttat tgcctgaggt
10801 ggcgctgctc acctcaggca ataagttgcc tgtgttgccc ttgtcatatg aggagtgctc
10861 tcaactcctt tgccaccatt gtttgcgttc cattctgtta agaattggtt gtgcaagcaa
10921 tggagtccat tttctgtaat ggtaaaatat gaatggtcaa attgattaaa aatgccattg
10981 tggaatgagt gagcagctca tcccatccat tctcctgatg ttaagagaat gaccatgatg
11041 ttgttatggt ttttgctcta tgtacagcct tttgtgtgaa tcgttgcgct gtacttcaac
11101 gactttgtca gtttccgggt ttgatcaagc ttcttcaaaa gcttgaacag gttgctcaca
11161 gggaggtgtc gcaactcacc tcatcagttg catacaagaa agcatwaag
```

FIG. 51 cont.

SEQ ID NO:43    PaRV genomic nucleotide sequence

```
   1 agtttttaaa agttaacccg tggttttacc ctagtttcgg tgaatttgcc aattttacgg
  61 aataactgtt tgaaaggttc aaactctggt gtccaacgtt tgtattaaaa tgagtggatt
 121 aggaggcctt cttcccctcc gagggaagaa aaagaaagcc cctgtgatac aatcacaggg
 181 cagggtcttg ccgaagagcg actggaaggg agctccgaaa caggatctaa ataaaaagaa
 241 agcgaaaaag gacgagacga aaggccagaa ttggccaaga agaattaacc cccggactgg
 301 acaatggtcg gcaattgagg gctctggtgc tcggctgtgg agaagcattt tctctacaga
 361 cttgatcgga ggcttgttgt tgttgatcgc tattttatca aatctctacg aaaaggttag
 421 acgtgacata acggaattga aacgcagagt gactcgattg gaaaaatctc gagctagttt
 481 gattttgacc ccaatggtgt tgctgtgtct ggctatcctc gcggcaggcg tgacaatcca
 541 agtggttgtc actactgatg cacgaatcga gctttggtct gaccggaaga actttacagc
 601 tcacgctcac ctcgtcaagg ttcctaccga cgtttgcaat gatggggtgt ttgtaacaaa
 661 acattgtccc aaagttgaga agttgagtga ccttggcgaa atcgattgcg gttcatcatg
 721 gtctgaattt accttgactt acacacgatg cgtaaccttg gaaagagcct cacgtgcgga
 781 agagaaggga aagacaatgc tggggcagtt caaggaggat cttccaccc tggaaactga
 841 ggcttttttg ctgtttaaaa aacatgcgtt ctcgaccatc ctggttttgc tagtattggc
 901 catcgttatg aagtggcccg tgtgggttgt ggtaatactg gggattctag cgtggaacgt
 961 cgtgaaaggt gagtttgttg agccattctt ggttttaaaa catgaccaca gtactatgct
1021 catgaccaga ctgtacccag gagaaatcgc tcacgttgca actcctgccg ggttggtgga
1081 cattcgtgtt agccatgccc aaattttgg aggtcaacgc tttcgtgagt tactgagcga
1141 ctgctctgtg aacgcttcgt attcgaccga catatgcccc ggaggatcac aacttgactt
1201 ggaatcgatc aaaggtcctg gacgtgtctg catgaccgct ccgtacaatc gaggatgggg
1261 aaccggatgt ttcaaatggg gaattggagc tgttgccacg tgcgttgagt tgaactgcac
1321 acgggaaaca aaagttgatt tgttgacaaa ttctgctatt gtggccaacg tgacagtcaa
1381 tttccactcg accaatgaca ctaaactcct tgtgcctgac accccaatta cgttgaagtt
1441 tgggaagtta ggaacgatga caatgacgtg tcgtttggga aatgaccgca ttgctaacga
1501 tttttaccat gtaactgaca atattgcatc tggactgttc cagaaaagctt tgattgatgc
1561 gtgggaagga ccctccaaga tggcgaacca cattagcgga catgaaaaag tcgtgaagtg
1621 gggtcacatt ctcccaaatg agatcaaggt cagcaagatc attgaaatgg agttagattg
1681 ggaaaaagcg atcaccacac atgatggatt ttcgaacacc tatttttggt gtcaagtggc
1741 cgtgaacaag ttggtcgttg ggtcatttgc ctcatgcaag agcggagcga aggctagctt
1801 catccaatcc tcgtggggtt ttgatggtgt ggttgaagtg acttggatg aggccaccaa
1861 aaccatttgc tccctacccc tgacatgtac cggatgtagc ttgttggcta caaaagtggt
1921 tttccttgag ggaagccagc gggctgttgg gcacgtgggg tgtggaaatg gaacatcaat
1981 gttgacagta ggaacgacaa aggtttggga tccaatgtgtg gtcacaccgg tgtcacaaat
2041 ttggaacttc gtgactcacg cttccggacg atatgcgaaa cttggttttg gaggagttgg
2101 aggagctttc catgatctgc tagtgaaggt tggattgacc ttcacctggg attcatggaa
2161 gatcatcacc gtgttgtctg gtctcgtagt ggcttttgcc atctttgatc ggaagttggt
2221 gatcctgatc attatcctct gtggaatcgc ttataccccga gctgacattg gatgtggcat
2281 tgattttgac aggaagacct acacgtgtgg aagcggtcta ttcgtgtgga agggtttggg
2341 aaaataccca acggccgacc attctgttga gtttgcctca tatgattttc tatcagcgta
2401 cctccaggag cagtttaagt ctgagaagaa ggtttgtatt atttgtgaag acattgtcca
2461 gtgtgaggca gctagaaaag cagccgctgc ggtgtataaa aacctaggcc acccgtttgt
2521 ctacgtgaac acgtcggact cctatggaaa agtatttgcc gaaatcccga aaagagtcca
2581 cactgttagt gtgggagtcg acgttgtgga aatggccatg atgactaggg agaacaaacc
2641 ggttggaccg tttggtgact taccgcgtag tatggtttcg tggaagagta tccctgaaac
2701 agaagagcac ccagtgttga gagtgttgac atcttcaagt gattaccaga aggtatgtgg
2761 aaaagcgatt ggattccagt atgatttgt tggataccgt cggaccatgt atggatctaa
2821 tgtccagtta aaaatatcaa agaaggtttc gattgaatgt cccacatact tggcaggagt
2881 cgccgtgaaa aatgatagaa cggttttcac tgatggaatg ttctggatgt catcgaaacg
2941 tgagaatgga acatacgcga tcactgagtt agagatggag cagtctcaca agtgcatctg
```

FIG. 52

```
3001 gccagaccaa tacactcctg acgccacttt gacgccacgt gacaatgaaa tgtttgttcc
3061 gcctgagtgg ggagggccaa tgtcgaaagc caaccacatt cctggttaca aaatgcagac
3121 tggatttcca tggaacaaag cccccattcg gtttgttgag ggaagtgttc caggaaccat
3181 tgtcacacag attagtcact gtgatggtag agggattgca gccgaagtga atccagcaac
3241 gcagcccaat tggtgctgta agtcctgtac aaggattttc cactttgaag tcgatgggaa
3301 actctattat ccaatggaga ttcggcccga cccgaaagga ggggaacagc aaaaagttcc
3361 tgtagtggag acacccattg gagatgaaga aaccgagact gttggtggat ggctgggtag
3421 aatgtataac attccaggag ctgagggatc atatgcggat tttcgactcc ccaagttgcc
3481 aaattcaaga ccaagcgcaa tggtggggag tttggtcaat ctattatgct tgatgttttc
3541 aattcagata gttaccaaga ctatgcgggc aagaacgctt atgcgtttct atctttgttg
3601 cttggttttt atgttctttg gaatgccaac tttgtttgga ttaagtgggt ttttggcgtg
3661 gatgatgatt ctaccaatct cacacaactc ggtaacaatg tgcaacctaa ccgtgcatct
3721 gtgggctgta ctgctaaacc agagctcggc gatgtttctg tggggcctaa cgctccgatc
3781 ccagatacag aggtctaccg ctggacagat gctactcttt accatgcaga tgttgcatca
3841 cgccatctac gcgcactctt gggtgttcgg gtgggtcatc gaagtatgct tgtcagtcgg
3901 gcttatgatg aacttgttaa ccgtcatcga tacggttcac ccgaaactga tcgcatactt
3961 gctcttcttc ggatggaaaa cgggcatgtg cgtagtgtgc gcttggttat tgatatactc
4021 aatcaggaga tggaactcta tagtcgccgc ggctccggcc gcgggcgggt ggaggtcagg
4081 gtatcgaaca atgatgtcct ccagtttgat tgttatcttt atcagtgtag gaattgcagg
4141 agttatcgct tcggactatg gaggttatcc ggctgcggct gcggtgactg cagcattgtt
4201 gataatggga atcaaaatgt ttgactttct gacgacccga ttgtctcttg agttcgtatc
4261 tgcaggcatg ttccccgaag gtgttgaaaa agccttgaa ccggactcgg tcagtgactt
4321 gtttagggca tctttcactg tagatgggat aaagttgcag gaccatgttg aaccgatccc
4381 catttttgttt gccatttttgt acatctttat tggagctgtg gcctgtaagg ttaacccggc
4441 cctcggaata gtgtatgcta tcgccatgtt cgcgactcct ttaccggagt taatgcgttt
4501 atacatgatg accatctatt cctctacatt tcggacagac actctgcttg ggatggctat
4561 cccagaaacg gagccagaac tgtctcaaga ctttgggcca atccctgatg ggatttatcg
4621 ggtgaacaat catggatttt cagtgaagag tcatcgggga gttggaatcg taaagaatgg
4681 ggtttttcac actctcatgc atgtcacgct caatgagcca ctcgcgtggc aaaatcgcct
4741 agtaggacct tcaatgggcc actctctcaa ggactatgtc acatacggtg gaaactggca
4801 attgcctgac tttgatattg ttaatgaggt gggcataatg gtttgtggac gggatcgttc
4861 cattcagtac aaaagacacg aggttgggac aatcatgatc gacgacaagc gagtgatgta
4921 cttcactcat gattacgggc acggatcatc tggttcacca attttgtga acggagaacc
4981 tgtggcctta tacggcttcg ggttccattt gtacaatagg tatcgatcaa tagttctgcc
5041 tatcccacgt gaagaagtcc ttgatggggc tagtaatgag ggcataccag ctgagcacgg
5101 aaccatgcgc aacaagtttt ttgttgactg gcatccagga aaagggaaaa cccgaaaagt
5161 gatcgttaaa gaggtgttaa atgctttgaa tttagcacgg cggattgttg ttctggcccc
5221 tacacgagtt gtcctggctg aaataactaa ggcaataggg gaaaacacat caaaaacgcc
5281 ctcaaaaaat cttgctttca ccggtcacaa tattgtgacg gtggcttgcc acgcgacgtt
5341 cactgattat gttttgcgtc atgggttatc aaaattcaaa gctcacgaag tcataatgga
5401 tgagtgccat tttctggacc cacgatctat agctgcgaga ggaatcctgg agcatctggc
5461 aactaaacgt ggagttaaag tcacgtttat gagtgcaacg atcccaggac gtgaaccttc
5521 actcgggtcg aattttgaga tctctgaaca ggccttgcag tttccccgtg acgtcaacca
5581 aaggtggata gaaactgttg ctaggggaaa gaccgttgcc ttcgtgccat ctcacagggt
5641 aggtgacaag ctagctcgcg ggtgtcccca agccatttcc ctgcatagga acaattttga
5701 caccaattac agcacagcta tggatgagtc cataaaattt atctacacca ctgacatatc
5761 ggaaatggga gccaatttca gtgctgacac cgtcatagat ttccgggtgg cgattaagcc
5821 aaagatttct agtgaatttg ccgtcactct tgaaccaact ccgatcacgc gatcatcgat
5881 gattcaacgg cgtggtcgag ttggaagaca acgacctgga acctatattt acccagttga
5941 caaaggcgtc gaagatgcct ccgatcagtt ggcttgttgg acagaagctc agatgttgtt
6001 ggatcaattg gacttgacaa tgatggcaga ggaagttcgg cagtcaaaca ttccaggggc
```

FIG. 52 cont.

```
6061 ttacaaatta gttgggcgta gcctagacat atttcggaag ttgctggaga aggatgacat
6121 accaatctgg ctgagctgga agtgggccga cagtgttcaa caacaatact ccatattgtt
6181 tgaaggagaa cgtcaagaga atgtcgctcg tgtcgtcaac actcgagact atgcttctct
6241 agagtataag ccgaagtttg ttgatgcacg attcgagcgt cttggatggg atcaacgaaa
6301 gctgtcaatt cagttttaca tgaacactcg gagcttcata actttcgcca ctttgtcaca
6361 cgtcatttct caagtgatcg aagctggagt tgtcaattct gcttggaagc gaataggaga
6421 cgttagcatc atctttactg aaggaggcga cccacatgct aaagatgaaa ctatcatggc
6481 ttggactatt ctggttggag gagtgttggg ggctcttgga ttcctcatag ttgcatgggg
6541 aatgaaggct gtcttgcgag taattttcgg atcccgcgat aagcatctta gcgtcccaac
6601 cttagtggcg gatttccaac catacatagt gtgtatagtt cccattgccc tacatcttgc
6661 tggggttcct ataccaatga caattgtgtt tttcgcgatg cttttcttga cttatccact
6721 aatgtacaag agtgccggac aacggagtta tgttgacatt gacttggtga aatggattct
6781 gttaggtgga tgtattgtaa ctggagtcat ttgctgggaa atgagattgc tcccaaacat
6841 ctcatcagac atttcagcta ttttgaatag gcaaagacaa agggaagaca ccccaacttt
6901 tgatgcttca ccaccttggg aatggttgga tttagcacag ccagtccctc acaatgttga
6961 attgacgtca gtggtgataa ctacattcac gacctgtctg ttcttgcacc aaattgtcgg
7021 atggtcatac gagtcagagt ggctgaaatc ctatttcgac cacaaaggag tgggtcagat
7081 catgggtggt tttcggttgg acacaatttc atggggatca gctctaagcg gtcttctggg
7141 cacagctact tatgcctcat ggggagccat tttgactggg ttaggaggag cggttgtgta
7201 tttttcctg atggtttcaa tgctcaagtg gaacttttcg ggaggagcca caactggctt
7261 agaaaacaat gtcatgcgaa acgaccgaga aactggacta ggtaatcggc cggcaaacga
7321 caataggcgt tccctcctgt acggtgtggt ggcggctgaa tgtctgtgt ggtgttctg
7381 tttcagaact gccacggatg ccatagtggt ggcttgttta gtgtcctatt gtttatggat
7441 catcaacaac ccggctagcc ctcaccacaa aaacactgac ttaggatcgg cgtgtagttt
7501 catcggtctt ttgtactgta catgtcctac tcaaaaatgc atccaagtat tgatgaggtt
7561 tgctttggcc aggttgaaca tgaacacccg ctctctggaa aaaagcgcga cgggaggcct
7621 tggacaccgt tggaagaagc tattaaatgc gatgacacta ttggaattca acgcttaccg
7681 atcttgtgga gttgacgaga ctgagaaggg tgactatgtt tcacgaggag ggctgaagct
7741 gagagagata accatgaagt atggttggaa gccagaaggg atatgtgttg atcttggatg
7801 cggcagagga ggatggtcac agcacttggc tatggatccc cgcgtaacta gagtggaatc
7861 attcacgtta ggaggaacag cacgagaaaa tccccagcca atcaagacac ttggtcataa
7921 ccttatccgg ttcaagagtg gagtcaatgt gtataatatg acgccaacac atgctaacac
7981 catagtgtgt gatatcggag aaaagtgaccc caaaccagag gtggaaacct ctagaacatt
8041 gcgggtcctc aaaacacttg aactatggtt ggccaggaat ccaaacgctg aatttgtgtg
8101 caaagtcctt tgcccatacc ccgtggaagt cctcaaatgt ctggaaaccc ttcaacataa
8161 gtatggcgga agaattatta ggtcgacgta tagccgaaat tcaagtgctg aaatgtatta
8221 catttctgga ggccgtaaca acatggtgaa ggttatcttc accaccctcc actccttgat
8281 ttcgaggata cgaactaggc cggagaaaat cgtcaaagaa agtgtttctc taccagttgg
8341 gactagaagc gatccagggc acaagatcaa gagtatggat ccaaagatga tagcaacgcg
8401 ggtggaaaag ataaaaaagg aacatgcgga cacgtggttc gttgacaaca accatccata
8461 ccaatcattt cggtatgtgg gatcgtacgt cacagatgat gtgacaccag gaggtcagac
8521 tgtcaaccca ttaatgagaa aaatgatgtg gccgtgggag actgttggag gagttgtaaa
8581 tttcatgatg acggacgtgt ccacatatgc ccaacagaag gtgttgcgag agaaggtcga
8641 cacactatcc cctgaacctc caaacgacat tcaaagggtt aacagatgga tcaccgagtt
8701 cttgtgtgct tcattcatgc gtcgagggtt gaaacctaga atcctgacca tggagcaata
8761 tatcaacaac gtaaagagct cagctgccat tggatcgtgg agcagtgatg tcccgtggag
8821 cagtgtccga gaagctttag ctgataaaag attccaccaa atggtcagg aggaaaggaa
8881 actccactta gcaggagact gccgcatgtg cgtgtacaac accatgggca agaaggagaa
8941 gaaaccttca gccatgggcg tggccaaggg ctctcgaacc atttggtaca tgtggttagg
9001 ttcacggttt ttggagtacg aagcccttgg cttcttaaat gaagatcatt gggtgtcacg
9061 agacaacttg gcatgtggtg ttggtggagt gggagtgaat tacttcggct actacctaca
```

FIG. 52 cont.

```
9121 agaaattgca cggaaaggga agtttttat cgccgatgac atagcgggat gggacacgcg
9181 gatcaatgag agtgacttgg ccgatgagga atttctcatc atgtccctca tttgtgaccc
9241 ataccatcga tcacttgcaa aagccgtgtt tcggtttgcc taccagaaca ttgtggcctt
9301 gtttccgcga aatcatcctg ggtttggaag tggaacggtg atggatgtcg tggccagaac
9361 tgaccaacga ggttcaggac aggtcgtgac ttacgctcta aacacgataa cgaacgccaa
9421 gattcaatta ggcagaatgc tggaagccga aggattacta gacgctcatg aacatgtaat
9481 caaaaaatgg ttaaacgaca atggtgaaga ggctctctcc gggatggtgg tggccgggga
9541 tgatgttgta gttgcgacca acaacggaaa tttttcaagg tccttacgat acctccattt
9601 gaacgggaaa attcgtaaag acattgatcc gtccctaccg tccaaagttg aaacgaactg
9661 ggaggtggtt gaattttgtt ctcaccatta ccacgtgatg accttaaagg acggacgacg
9721 aataattgtc ccatgccgag agcagaatga aatcattgga cgaggcagga ttcaaaaagg
9781 agggttggtg acccttgccg aaagtgcctg cctagcgaag gcttatgggc aaatgtgggc
9841 tttgtatttc tttcaccgaa gagatctgcg gatggctttt ctagccataa cttcgagtgt
9901 tccaatagac tggttcccag agggccggac ctcgtggtcg attcaccaaa ataaagagtg
9961 gatgaccact gaggacatgt tgcgggtctg gaatacagtg tggatccagg acaatccctg
10021 gatggaggac aaaatggaaa tcgaaaattg gagggacatt ccgtacctcc cgaaatccat
10081 ggacctaaag tgcggcagtc tcattggaac aaaagaaaga gccgcttggt caaaggatct
10141 gccgtcaacg gtcacggcag ttcggaaaat tatcgaccaa gacacgaaaa ccgagaatgt
10201 ctaccaagac tttcttggcg gaatgggccg gttccaaacg tacactgacc ccatggcaac
10261 gtaagaaacc atctttcca aattagtcga aaaattttgc ccctcttcga ggggctttgg
10321 cggcagcagg agattttctc cggggtttca cgctccccc gatgccagtg gtcacagccc
10381 aagtcagaga cttggagttg tgcggggaca gtgagctctg tcagtggtca atagctcaat
10441 aaatatggca gcagagcttg tctcggggat tcacgctccc cccattgtga gtgtgtcgaa
10501 ctggtttcga aggacgtcta gaacgacgct aaagttcaaa tccggcaaca gagagtttat
10561 gtctcggggc ctcacgcacc ccccgttgtg agtgaagtcc tttctggcca tttagtggtc
10621 aggaagggta ccgttttgga acgacggaaa taagttccat ggagcgacac tagccccact
10681 gaggggcggt tggaatgaca cccaacccgc tatagtgcgt cgacaggtca attagctacc
10741 tggaataagc taatgtgcag ggcaacaaag ttctaacgaa ctagggtgag tagcgtcacc
10801 ccccggttgt gaaaacgatt gcgactagaa ctaaagtcga gagtctcccc accgataggg
10861 gagctcgtca gtttgtttta gtccaattac gct
```

FIG. 52 cont.

SEQ ID NO:44 CFAV genomic nucleotide sequence

1 acttcggctt agctacacca cagttttggt tacgcttata ttttcaaagc ttaagttgtt
61 tttaattttt gccgagagac cgtgaggttg aacccggcaa ggaatgaaga ggaaggattt
121 ggaggcgcga ggaaaagcgc cagggaggga tttttccacc ccgttctggg gaagagaagg
181 taggagaaag gacaaggaaa agggaggga gtctccctca aatcggcaag tgaccctgaa
241 tacacccatc cagagtgggc gtagggcagg gaaaagacag cgtgttggcc tgctaggaag
301 gctgggagtt ggatggggat ccttcttaca ggaggacatc gtccaagccc tcattcacat
361 ggcattggtg cttcatgccc tgttttcctc catcgaccgg cgaattcgct cattatctcg
421 acgtgttacc gctcttgaat ctcgacgaac cacaggagat cctatgacgc tagctttcat
481 cttgggcttt ctcacagtgt tatgtggatg cgtggtgatt gacatgcaag tttctaccgc
541 taagggcacg gaaatttttg aaggaaagac gaaccggaca gactacttgc atctggtcaa
601 gttacccgct gatggttgct ggagtggcat tcttgtcaca aagaagtgcc caaaagtgac
661 tgacttggca aaggacctcg agtcaacaga ttgcggatca acgtggactg agttcacatt
721 gcggtatcgg agatgtgccg tgaagaaacg tgaaaagcga tcacgtgaac cccgaaagc
781 ggatctgcta gctgaaatgg agatcatcgc gttcaagacc attcgcgaaa ataagacgat
841 tttcatcgtg gccctactgt gtgtggcaat cgcgaagcgt tggcccacct gggttgtgat
901 tcttctggct attggcactt ggaccacagt aaagggggag tttgttgaac cgttatacac
961 gctgaaagcg gaacagatga ccatgctaca gaccattgtg agaccggagg aagggtacgt
1021 cgtggccacg ccaaacggtc ttctcgagtt taaaacagga ccggcggaga tctatggggg
1081 gcaatggctg cgcgagttac tcgcagactg ccacgtcaac gcatcctatt cgactgacgt
1141 gtgtcccggt ggatcgcagc tcaacatggc tgacatcatg gccaaggaac gagtatgctc
1201 gacccagcca tacaaccgcg gttggggcac tgggtgcttc aagtggggga ttggattcgt
1261 tggaacgtgc gtcgaactcc attgcgacag aggattcaac gtttcttcca tcgctaggtc
1321 agccattgtc atgaacgtta cggctagctt ccactctgtt agcgacacac aacagatggt
1381 tggcgacata ccgcttacat ttaggtttgc gaaactcgga aacgcggcga tgacctgcag
1441 gttggagtct gagcagttgc tgcttgatta ctatcacgtt acgggaagct ctcacgaggg
1501 gctgtttttg cggtcgcaaa ttgacagttg gcctggtgtg cactctaccg ctagtggtcg
1561 gcatggcatg gagaaagttg ttgtgtgggg agatgctagg tccaatgaga tattggtaaa
1621 aaacgtaatt gaaccttcgt tgtcctggga agacgcgatc gccacccatg atggattccg
1681 tgatatctct tttgtttgtc agattatgct cgacaaacta gtcagtggag cttttcgaga
1741 ctgtccaggc ccaaaaacat ccacattttc ccaagacggc tttgggtata gtggagtggt
1801 gataactacc ctcaccgctt cttcaaatga gacctgttcg cttagcttaa cgtgccacgg
1861 ctgtctgctg caatccacaa aaatgatctt tctcgcaggg aagacaactt ctcgggcatt
1921 tgtcaagtgt gggaaccata cgagcacctt gctcgttggg agcacttcag tttccattga
1981 gtgtgccctt aaccctatct cgcaaggatg gcgcctggct cgacacgtgg tggataggta
2041 tcgacggttt ggcgtgtctg gtgttgcggg agtgtggcag gatctggttg gaaagttttc
2101 ggttggtgcc tttttctcca acacaaccct tctagtcatt ttcgtcctcg ctgccttgat
2161 tgacaaacgc atagcctttc tgttggtttt aggggggtac ttttactatg tgcgggctga
2221 tctggggtgt gggattgaca ccacgagaaa aaccatctcg tgcggcagcg gcgcttttgt
2281 gtggaaacac ttgggcgttg gcatttccaa tgatcatgct gtggaacttg aagattactc
2341 attcactgac ttgtacataa aggatatgtt tagctggacc acgaaaccct gcttgatttg
2401 tgaggatgct ttgcagtgcg tagccctgcg cagagctgct ttctctgctg ttgggtcaat
2461 gggtcctgaa caggtgtatg taaatgacac attggcacgt acattcaagt tctccgaaac
2521 accaaagaga accatttccg tcaccattaa cctaattcag tacaagttct catcttatgt
2581 tgcacatgga cgcgctgagg gtgatctggg gcatctacca acaatgtttg gaagctatcc
2641 cgaaaaagag gctgataagg ttatccggat tgtcgcatcg cggcccgata ttcgccgact
2701 ttgcggaaaa gctgtctctt tccaattcaa gtttacgggc ttccggcgag gcttgtatgg
2761 ttcaaacgtt caggttgagg tctcaaagaa ctcatcgacc gagtgtccca cgtacctggc
2821 gggcgttgtc gtgaagaatg gccgaactgt catcactgac ggcatgtttt ggttggaaag
2881 cacagtgttg gatggagttg cccagattac atcacttgag atgcgtcaat cacaccgctg
2941 tgtgtggccc agggaataca ccccagacac gctcagtgac ccttcagacc aagctttatt

FIG. 53

```
3001 tattccacct gcttgggggg gaccaatttc gcgagtgaac cacataatcg ggtacaagac
3061 acaaactgac tttccgtgga acgttagtga catcactctc atagagggcc cagcccctgg
3121 cacaaaggtc aaggtggact ctagatgtca tgggcgaatg cacgcacagg taattggacc
3181 gaatgacacg gaatcctggt gttgccaatc atgcacaaga atagtccact ttcgagttgg
3241 tgacctccta tattacccca tggagatcca acttggaacc atgtctgaag cgccagagcc
3301 gaattctaaa atatttgagg aaccgatcgg cgaggaacca gaaccaacag ttgacgacat
3361 attgaagaga tacgggaagg caaacgctca atcggatttc cggagggtga gcccacgtgc
3421 aggagttggg ttcgaccgct ccctcctaaa tctcctgtgc ctcgctattt cattgcagct
3481 tatcggggca aaaaccagaa catcgacact aacccgtcta tttctgacga ttctagcaat
3541 ggcgctcttt ggactcccca atttgttttc atctgtgggg ctatctgctt gggtgttgct
3601 agtggcgtcc tcatcatcgc aaccgcaaga tctattgatg aatctctgga tcatactaca
3661 gactgggagc tcagcagtcc tgctgttggg gtacatgatc aggaagaaac tctcaatagt
3721 gctagggggtc caccacttgg tgactttgat gtgcattcag ttcctgttct ccgccgtcga
3781 tcgctatcag aaatatctct acggtctcct agaactcatg gcttcggtgg tcctgctgag
3841 cgcctacaag agcgtcctgc aggctctccc cccagaggtt ctatgtttca gcctgataat
3901 ggggtggaag acagccctgt ctctcgctac cgttgtgtct ctgatcttca gtttgaacgc
3961 tatgtacaag tacgcatgtc aatatcacaa tccgaggaac ggctacagag actctggcgc
4021 gaatttatgg ttttggactg tatccttggc gagcgctggg ggaatctggg cggcggagaa
4081 agctcaccaa ccaacggtgg cagctgtcct agcctttaca atgatagtgc tctttcttta
4141 catggaacag acgaacgtca gtatggagct tgagttcatc tcagctggag agactcccga
4201 aggagtgtca accgaaaatg atgacgggat gaatattcct gacttaaaag ggcgctatgg
4261 ggaggatggg atcgtcgtgg gggcggcctc atcgtctggc cacctacccg agctcgtgtt
4321 tgtgttcctc ctaggttttg ccgtgacgtc cacttcatac tttttggggg cgctctacct
4381 gctcatcgca accagcacta accttcccgt gaccataata cggatgctgc gtatgaagct
4441 cactgccaac aaccgatctg atgatctctt gggactcggc ggacctattg aaactgatct
4501 ccagaccagc tttcaagaca ttcccaatgg agtgtatcgc atcgttgttc gcagcttatt
4561 tggcgaccgg caacgagggg ctggcttctc gaaaaatggg gtgtttcaca ctctcatgca
4621 cgtcactcga ggtgaaccag ttaaatggcg tgggcgagtt gtcgttcctc actctggtag
4681 tgccttgcgc gacgtggtgt cgtatggtgg accttggcag ttggacaccc ccactaccac
4741 ggaagacctc gtgctgatgg cttgcaaacc ggacaagacc gttgagtacc atcggtacag
4801 gccgggagtc atgagtattg acggtgaacc tgtcatgttc attagtgatg atttcggaaa
4861 aggatcttct ggctcaccgt tcttcattaa tggcgagccc gtcgggttct atggttttgg
4921 gttctatgtg aacggcattt atcgctcaac agtagcaggt ggtaaaccaa ccgatgtcac
4981 ggagaacttg gactgtgatt cgaccaggcg gttcgtgaca tggcatccgg gaaaaggaaa
5041 gacgcgcaag gttattgtcg aagaaactaa gaagaactat gattccaacc aacggaccgt
5101 gatcttaaca cccacccggg tagtcatggc tgaggtcgtt gaggccttga gaactcagg
5161 catgaggagt gataagaacc tgtcgtactg caccaggaac ctgataacgg ttgcatgtca
5221 cgcaacgttc acgaaatttg ttcttagcca tggcgccaag aaagtgcggg ttgccatgat
5281 catcatggat gagtgccatt tcatggatcc tatgtccatt gctgcgcgcg ggatcatgga
5341 gcatctccac agccaaggaa caaaattgat ttaccttagt gcaacaccac ccggccacgc
5401 gcctgataca ggctcgaatt atgcaataag tgaccaatcc attagcttcc caacctggtt
5461 gagtccagcg tggataggaa acgttcaaaa atccgtgggg gcgaagaaga ccattttatt
5521 cgtcccatcg cacaaccaag ctaacaccct ggctagtgct attcctggat ccgtcccatt
5581 gcatcgagca aactttccca ctaactatgc acaagcgggt gatgcagcca ccgccctggt
5641 aatctccacc gacatctcag aaatgggagc gaatttgggc gtcgatctgg ttatagacac
5701 tcgaagagct ttgcgacccc ttgtggattc tgccacgcgt gtgaagctgg ttgaaacgaa
5761 cataaccaca tcatccatga tccagaggag agggaggacg ggaagacggg aaccaggaac
5821 gtatgtgtat cctattgata gccaaacgga ggaaaatcca gtgtcttggg cgtgttggcc
5881 tgaagcccaa atgactctgg accagctcgg catgactttt atgctagagg aagccgcata
5941 cagccaaccc ccggggagat tcaccctagt gggagaggat agaatgcgat tttcaaagct
6001 tatggaccgg gatgacattc ccatttggtt ggcgtggcac tgggcagaag ctggggaccg
```

FIG. 53 cont.

6061 acggcactca gccctgtttc agggcgaagg aaccggaaag atcatcgaga accgatttgg
6121 caaacaagag tatcgaccac aatacgttga tgaccgcttt gagagcgttg agtgggagac
6181 gcgcaaggtg tccattgatt tctacatgaa ctgccgcggg gggcctagcc tctatgagtt
6241 tttcacattg attgattgga ctgacatatg gaggagaacg acatctgctc tttgggattt
6301 gagtgacgtc atgaatggag aactgcgtga ccggtccaca actgagcgct cccttaccgt
6361 gctaatggct tttgtcttgg gcgtctcaat tgtgctctcc tgtttcatcg ctgtctgggc
6421 attgtgtttc ctattctcct tgtttaggcc gcgaaaggta acttatgagc aaatgccatc
6481 tagtgaccca cttagcggtg gtgtcttggt gtcaacccct agcctccttt attatatggg
6541 agtccccttg gggttctgcg tcgtcatatc actggctatg ttcttggtgt acccagtatt
6601 gtacaagtca attggaaatc gcagttacat ggacagcgat ttggtaaagt gggtcatctt
6661 gggatcatgt ctgatctgcg gagtgctggc ttgggagatg cgaatgttcc cgaacatacg
6721 tggcgacctc atggagctcg tgaaagctgt caaggagccc gaggaggtcg tgaattccgg
6781 gccatttttt ccaagttggg aaatagcgcg gggaaaggga gctacaatgt tggactctct
6841 gcaggtattc ttcttcataa cagtgttgtc aacaaaattc ttgtactggt tccaggagaa
6901 ctggactgca cgaatgtacg ccatgaaaca tccggagatg gttagctcga ttggtggatt
6961 cagatttgat gaaattccat tcagggcagt ccttccctct ggttttgcca ttgtcgcgat
7021 tgctagcctc tcaagtgtgg tggtggggct tctggcagct ggtgtgttca tggccatcat
7081 gtactgtcag aacaagtgga atgccacccc aaagatcttg acagcattgg acgctcgcga
7141 ccagagacat gatcgtccca ctgaaatcac tagtagagtg ccactcgaaa acactcggtc
7201 catcatgtat gccttttgct tgatcttcag cctgttttgg gctttctgca cacggtctcc
7261 tggagatttt ctccgagggt cattggtggt cggggctagc atgtggcaaa ttctccatcc
7321 ccggtcaaag atccatgatg tcatggattt tggctccatg gtgtctgcca tagggttgct
7381 agaaatgaac tacctttttt ataggttcat gcacattgcc gctagagcct tgggcgcggt
7441 agctcccttc aaccagtttc gagctctgga aaagtcaaca acgatcggtc tgggaatgaa
7501 atggaagatg actctgaatg ctcttgatgg agatgcattc acaaaataca aatcacgcgg
7561 ggtaaatgag acggagcggg gtgattatgt ctctcgtggc ggcctcaaat tgaatgaaat
7621 catctcaaag tacgaatgga gaccgagtgg tcgagtggtg gatttgggat gtgggcgcgg
7681 tggctggagc cagcgagctg tgatggagga aacggtgtcc tccgctctcg ggttcacaat
7741 aggtggggcg gaaaaagaga atcctcagcg attcgtcacg aagggatata acctggctac
7801 gctaaaaact ggagtggatg ttcataggct cacccccattc cggtgtgaca ccattatgtg
7861 tgacatcgga gagagtgatc ccagcccaat caaggaaaag accagaactc tcaaagtctt
7921 gcaattgtta gaaaattggc tcttggtgaa cccgggagcc catttgtgt gcaagattct
7981 atcaccatat tctcttgaag tccttcggaa aatcgagtcc ctccaacatc tgtacaatgg
8041 caggttggtg cgcctctccc acagtcgaaa tagctcggct gagatgtact acatctccgg
8101 ggctaggtct aacgtggtgc gcaccacata catgacgctg gccgccttaa tggcccgctt
8161 ctcccgacac ttagacagcg ttgtcctccc gagtcctgtg ttgcccaaag gcacacgggc
8221 tgacccggct gctagtgtgg catccatgaa taccaacgac atgacggacc gtgttgaacg
8281 cttaatgaac gagaaccgtg gaacatggtt tgaagatcaa caacacccct acaagagttt
8341 caagtatttt ggatcgtttg tcaccgatga tgtgaaggta ggagggcaag cggtgaaccc
8401 cctcgttagg aagatcatgt ggcatggga gactctcacg agtgtggtgg ggttttccat
8461 gactgacgtg tcaacctact cacagcagaa ggtactgagg gagaaggtgg acactgtcat
8521 ccctccccac ccacagcata tacggcgggt caacaggacg attacaaagc attttatccg
8581 gttcttcaag aatcgcaact tacgaccgcg tatttatca aaagaagaat tcatcgccaa
8641 cgttcgaaat gatgcggctg taggatcgtg gagcagggat gtgccatggc gagatgtgca
8701 agaagccata caggaccagt gcttctggga tctcatcgga aaggaacggg ccctccatct
8761 gcaagggaag tgtgaaatgt gtatctacaa caccatgggc aagaaggaga aaaagcccag
8821 cctagctggt gaggccaagg gctcaaggac catctggtac atgtggcttg ggagccggtt
8881 ccttgaattt gaggctctag gcttcttaa tgcggatcac tgggtcagta gggagcactt
8941 ccctggggga gttggaggcg ttggtgtcaa ttattcgg tactacttga aggacattgc
9001 cagcagagga aaatacctttt tcgcggacga cattgctgga tgggacacaa aaattagcgc
9061 ggaggatctg gaggatgagg aagctctcct aacagccctc acggaagacc cccaccacag

FIG. 53 cont.

9121 agcgttgatg gcggctacca tgcgactggc atatcagaac attgtggcca tgttcccacg
9181 aacacactca aaatacggca gcggcacggt gatggacgtc gttggccgtc gggaccaacg
9241 tgggtcaggg caagtagtca catatgcgct gaacaccata acaaatggta aggttcaggt
9301 ggcgagggtt ttagaaagtg aaggactact gcatgcggat gaatcggtgt tggatgcgtg
9361 gttggaaaaa caccttgaag aagctctcgg aaacatggtc attgctggag acgatgttgt
9421 tgtgtcgaca gacaatcgcg atttttcatc tgctctcgaa tatctcgagc tgacgggaaa
9481 aactcggaag aacgtcccac agggagctcc ctccaggatg gagagcgact gggaaaaggt
9541 ggagttttgt tctcaccatt accatgaaat gtgcctgaaa gacggcagaa tcctcatagc
9601 accttgcaga catgagaacg aagtgcttgg tcgtagccga ttgcaaaagg gaggggtagt
9661 cagcatctcg gagagtgctt gcatggccaa ggcctatgcc cagatgtggg cattgtattt
9721 tttccacagg cgtgatttac gcctaggttt cattgccatc tcgtcggctg tgccaaccaa
9781 ttggttccct ctaggacgta cctcgtggtc agtccaccag catcacgaat ggatgaccac
9841 tgatgacatg cttcgggttt ggaatgacgt gtgggtgcac aacaacccgt ggattctaaa
9901 caaggagtca attgaatcct gggatgacat cccctacctg cacaagaaac aggacataac
9961 ctgcggaagc ctgatagggg tcaaggagcg cgcaacgtgg gcacgagaga ttgaaaatag
10021 tgtcatcagc gtccggagga taatcgacgc agaaactggg gtcctgaaca cctacaagga
10081 cgagctctca gttatgagtc gatatcgaag aggaaatgat gtcatttaga cgaaatcgaa
10141 tagagccgtg aggaaccagc atcctcccgg ccacaggagc agggcatgaa aatgtcgggc
10201 atgacgaacc cgctcccccg agtccctgg caacagggtg tgttcccta tggagcacgt
10261 tcgagcaggg cacattagtg tcgggcgtga cgcacccgct cccctcagtc ccctgtgcaa
10321 cagggagggc acttgtaacc cccgtaggag ggtgcccgct tccgtcctac aaaaacctct
10381 gatcataggt acctgatcta agatggtggt ggcggcccat cttatcattt agctagctga
10441 tggtcttaag catccctccc atggaatggg taagagaagc ctgcaaacaa aactggatgg
10501 caccagtgct cttacaaaat ggcagccaaa gcgatccaga gctttcaaaa ctggacgggg
10561 caacagggag aaatcccggg gtagcgaacc tcctccgtta atgtgaaaaa gtatggggaa
10621 agaactcatc ttaacctccc accgttaggg agttttgatt atcttttcta taccatagat
10681 gc

FIG. 53 cont.

>SEQ ID NO:45  WNV$_{KUN}$ genomic nucleotide sequence

```
   1 agtagttcgc ctgtgtgagc tgacaaactt agtagtgttt gtgaggattt tgaacaatta
  61 acacagtgcg agctgtttct tagcacgaag atctcgatgt ctaagaaacc aggagggccc
 121 ggcaaaagcc gggctgtcaa tatgctaaaa cgcggaatgc cccgcgtgtt gtccttgact
 181 ggactgaaga gggcaatgtt gagcctgatt gacggtaggg ggcccacacg gtttgtgttg
 241 gctctcttgg cgttttttag gttcacggca attgctccga cccgggcagt gctggatcga
 301 tggagaagtg tgaacaaaca aacagcgatg aaacatctcc tgagtttcaa gaaggaacta
 361 ggaaccttga ccagtgctat caaccggcgg agctcaaaac agaagaagag aggaggaaag
 421 accggaattg cattcatgat tggcttgatt gctggcgtgg gagcagtcac tctctccaac
 481 tttcaaggga aggtgatgat gacggtgaac gctactgacg tcacagacat tatcacgata
 541 ccaacggccg ctggaaagaa cctgtgcatt gtcagagcta tggatgtggg gcacatgtgt
 601 gatgatacta tcacctatga atgtccagtg ttgtcggccg gaaatgatcc agaagacatt
 661 gactgctggt gcacgaagtt agcagtctac gttaggtatg gaagatgcac caagacacga
 721 cactcaagac gcagcagaag gtcactaaca gtgcagacgc atggagagag cacccctatcg
 781 aacaaaaagg gggcctggat ggacagcacc aaggctacaa ggtacttggt aaaaacagaa
 841 tcatggatct tgagaaaccc tggatatgcc ttggtggcag ctgtcattgg atggatgctc
 901 ggaagcaaca ccatgcagcg tgtcgtgttt gccgtgttac tgcttttggt agctccagct
 961 tacagcttta actgtcttgg aatgagcaac agagatttcc tggagggagt gtccggagca
1021 acatgggtgg acttggtcct tgaaggtgac agctgtgtga ccattatgtc caaggacaag
1081 cccaccatcg atgtgaagat gatgaacatg gaggccgcta acttagcaga agtccgcagt
1141 tattgctact tagccactgt cagtgaactc tccaccaagg ctgcgtgccc aaccatgggg
1201 gaagcccata atgacaagcg ggctgaccca tcttttgtgt gcaaacaagg agtagtggat
1261 agaggttggg gcaatgggtg cggactttt ggtaaaggaa gcatcgacac atgcgccaaa
1321 tttgcctgtt caaccaaggc aacgggaagg actatcttaa aggagaacat taagtatgag
1381 gtggctatct ttgtgcatgg accaactacc gtggaatcgc atgggaacta cttcacgcaa
1441 accggagctg ctcaggctgg gagatttagt atcacccccg cggcaccctc ttacactctt
1501 aagctcggag agtatggaga agtaacagtg gactgtgaac cacgctcagg gatagacacc
1561 agtgcatact atgtgatgac tgtcgggaca aagactttct tggtccaccg tgagtggttt
1621 atggacctca acctcccctg gagcagtgct gaaagtaatg tttggaggaa cagagagacg
1681 ctaatggagt ttgaagaacc acacgctacg aagcaatctg tgatagcatt gggctctcaa
1741 gagggagccc tgcatcaagc tctggcagga gccattcctg tggaatttc aagcaacact
1801 gtcaagctga cgtcaggcca cctgaagtgt aggggtgaaga tggaaaaatt gcagctgaag
1861 gggacaactt atggcgtctg ttcaaaggcc ttcagattcc ttgggactcc cgcagacacg
1921 ggccatggta ctgtggtact ggaactgcag tacacaggca cggatggacc ctgcaagata
1981 cccatttcat cagtagcttc attgaatgac ctaacgccag tgggcaggtt agttaccgtc
2041 aaccccttg tctccgtgtc aacggccaat gctaaagtcc tgattgagtt ggaaccaccc
2101 tttggagatt cgtacatagt ggtgggaaga ggagagcaac agatcaacca tcactggcac
2161 aagtctggaa gtagcattgg caaagctttc acagccaccc tcaagggagc tcagagacta
2221 gcagctctgg gagacacagc ttgggactttt ggatcggttg gaggagtgtt tacctccgtg
2281 ggaaaggctg tccatcaagt atttggtgga gcattccgct cattgtttgg aggcatgtct
2341 tggataactc agggtctgct gggggccctc ctattgtgga tgggtattaa cgctcgtgat
2401 agatccatag ccctcacgtt cctcgcggtt ggaggagttc tgctctttct ctccgtgaac
2461 gtgcatgctg atactggatg tgccatagat ataagtcggc aagagttgag gtgtggcagc
2521 ggagtattta tacacaatga tgtggaagct tggatggacc gatcaagta ctaccctgaa
2581 acaccacaag gtctagctaa gatcattcaa aaggctcaca aggaaggagt gtgcggtcta
2641 cgatcagttt ctagattgga acaccaaatg tgggaagcag tgaaggatga actaaacact
2701 cttttgaagg aaaatggtgt ggaccttagt attgtggttg agaaacagga ggggatgtac
2761 aaatcagcac ctagacgcct gactgccacc actgagaaac tggaaatagg ctggaaagcc
2821 tggggggaaga gcattctgtt cgcaccagaa ctggccaaca cacttttgt gattgatggt
2881 ccggagacca aggagtgtcc aacccagaac cgtgcctgga acagcttgga ggtggaagat
2941 tttggattcg gcctcaccag cactcggatg ttcttgaggg tcagagaaag caacacgact
```

FIG. 54

3001 gaatgtgact caaagatcat cgggacagcc gtcaagaata acttggcgat ccatagcgat
3061 ctatcctact ggattgaaag caggtttaat gacacgtgga agctcgaaag ggcggtccta
3121 ggtgaagtca aatcatgcac gtggccggaa acacataccc tgtggggtga cggggtcctt
3181 gagagtgacc taataatacc aatcacgcta gcgggactgc gaagcaacca caaccggagg
3241 cctgggtata aaacacaaag ccagggtcca tgggatgaag gtcgagtgga gattgacttt
3301 gattactgtc cagggacaac ggtcactctg agtgagagct gcgggcatcg tggacctgcc
3361 acccgcacca ctacagagag tggaaagctg ataacggact ggtgctgtag gagctgcacc
3421 ttacctccat tgcgctacca gacagacaat ggttgttggt atggcatgga gattaggcca
3481 cagagacatg atgaaaaaac tcttgtgcag tcacaggtga atgcctacaa cgctgacatg
3541 attgatcctt ttcagctggg ccttctggtc gtgttcttgg ccacccagga ggtccttcgc
3601 aagaggtgga cagccaagat cagcatgcca gccatactga ttgccctgct agttctagtg
3661 tttggggggca tcacttacac tgatgtgtta cgctatgtca ttctggtggg ggcggccttt
3721 gcagaatcca actcaggagg agatgtggtg catctggcgc tcatggcaac cttcaagata
3781 caaccagtgt tcatggtagc atcatttctc aaggcgagat ggaccaacca agaaaacatt
3841 ctgctgatgt tggcagctgc tttcttccaa atggcttact atgatgcccg gcaaattttg
3901 ctttgggaaa tgcctgatgt attgaattca ttggcagtgg cttggatgat attgagagcg
3961 ataacgttca ccacaacatc taatgtggtc gtcccgctgc tggccttgtt aacacctgga
4021 ttgagatgcc taaacctgga tgtgtacagg atcctgctac tgatggttgg aataggcagt
4081 ttgatcaggg aaaaagaag tgcagctgca aaaagaaag gagccagtct gctatgtttg
4141 gctctagcct caacaggatt tttaaccccc atgatccttg ctgctggact tgtcgcatgt
4201 gatcccaatc gcaagcgggg gtggccctgca actgaagtga tgacagctgt cggcttaatg
4261 tttgccatcg ttggagggct tgcagaactg gacatagact ccatggccat tccaatgact
4321 atcgcagggc tcatgtttgc tgcttttgtg atctctggaa aatcgaccga catgtggatt
4381 gagaggacag cggacatctc ctgggagggt gatgcggaaa tcacaggttc cagtgaaaga
4441 gttgatgttc ggcttgacga tgacgggaac ttccagctca tgaatgatcc aggagcacct
4501 tggaaaatat ggatgctccg tatggcttgc ctggcaatca gcgcgtacac cccttgggct
4561 attttgcctt cagtagttgg attttggata actctccaat acacaaagag aggaggtgtg
4621 ctgtgggaca ctccctctcc aaaggagtac aagagagggg acacgaccac tggtgtctat
4681 aggatcatga ctcgtggatt acttggtagt taccaagcag gagcaggcgt gatggttgaa
4741 ggtgttttcc acacccctctg gcacacgaca aaaggagccg ctctgatgag cggagaaggc
4801 cgcctggatc catattgggg cagcgtcaag gaggatcgac tttgttatgg tggaccctgg
4861 aaactgcagc acaagtggaa tgggcaagat gaggtgcaaa tgattgtggt ggaaccaggg
4921 aagaatgtca agaacgtcca gactaagccg ggggtgttca aaacacctga aggggagatc
4981 ggggccgtga ctctggattt cccccactgga acatcaggct cgcccatagt ggacaaaaac
5041 ggtgatgtga ttgggctta tggcaacgga gtcataatgc ccaatggctc atacataagc
5101 gcgatagtgc aaggtgaaag gatggatgag ccggttcccg ccggattcga acctgagatg
5161 ttgaggaaaa aacagatcac cgttttggat cttcacccctg gtgctggtaa aacaaggagg
5221 attctgccac agatcatcaa agaggctata aacaggaggc tgaggacggc tgtgctggcg
5281 ccaactaggg ttgtggccgc tgagatggct gaagccctaa gaggattgcc tatccgatac
5341 caaacatctg cggtggccag agagcacaat ggaaatgaga tcgtcgacgt catgtgccat
5401 gcaaccctca cccataggct gatgtctcct catagggtgc ctaattacaa cctatttgtg
5461 atggacgagg cccacttcac cgacccagcc agcatcgcgg ctagaggata catttccacg
5521 agagttgagc tggggggaggc agctgcaata ttcatgactg ccaccccacc aggtacctca
5581 gacccatttc cagagtccaa tgcaccaata tccgacttac agaccgaaat cccggaccga
5641 gcctggaact cagggtatga gtggattaca gaatatatcg ggaagacggt ttggtttgtg
5701 cctagtgtga agatgggaaa tgagatagcc ctctgtctgc agcgcgctgg caaaaaagtc
5761 atccagctaa acagaaagtc gtacgagaca gagtatccaa aatgcaagaa cgatgattgg
5821 gactttgtcg tcacaacaga tatatctgag atgggagcaa actttaaggc aagcagggtg
5881 attgacagcc ggaagagtgt gaaaccgact atcatcacgg aaggagaggg aagagtgatc
5941 ttgggggaac catccgctgt gacggcagcc agtgcagccc agagacgagg acgcattggt
6001 aggaatccat cacaagttgg agatgagtac tgctatggag ggcacacgaa tgaggatgac

FIG. 54 cont.

```
6061 tcgaactgtg ctcactggac tgaggcacga atcatgctcg ataacatcaa catgccaaac
6121 ggattgattg ctcaattcta ccaaccagag cgcgagaagg tatacaccat ggacggggaa
6181 taccgactta gaggagagga gaggaaaaac ttcctggaat tgttgagaac tgcagacttg
6241 ccagtatggc tagcttataa ggtggcagca gctggggtgt catatcatga ccggaggtgg
6301 tgttttgatg gccctaggac aaatacaatc cttgaagaca acaatgaagt ggaagtcatc
6361 acaaagcttg gtgaaaggaa gattctgagg ccacgctgga ttgatgcaag ggtgtactca
6421 gaccatcagg cgctgaaatc attcaaggac ttcgcctcag ggaagcgctc tcaaataggt
6481 tttatcgagg tccttggaaa gatgcctgaa catttcatgg ggaagacatg ggaagcactc
6541 gacaccatgt atgttgtagc cactgcagag aaaggaggaa gagctcacag aatggctttg
6601 gaggagctac cagacgccct ccaaacaata gctctgatcg ctctgttgag tgtgatgacc
6661 atgggagtgt tttttcttct catgcagagg aagggcatcg gaaagatagg cctgggaggc
6721 gttgtcctgg gagccgcaac cttttctgt tggatggctg aagtaccagg aacgaagatt
6781 gccggaatgc tgctgctttc cctccttctg atgatcgtgt tgattcctga gccagagaag
6841 caacgctcgc agacagacaa ccagctagct gtgttcctga tttgcgtgtt gaccctttgt
6901 ggtgcggtgg cagccaatga gatgggttgg ctggacaaga ccaagagtga cataagcggt
6961 ctgtttgggc aaagaattga aaccaaggag aattttagca ttggggagtt ccttttggac
7021 ctgaggccgg caacggcttg gtcactgtat gctgtgacta cagcagttct cactcccttg
7081 ctaaagcact tgatcacgtc agactacatc aacacctcat tgacctcaat aaatgttcaa
7141 gctagtgcgc tattcacgct cgcgcgaggc ttccctttg tcgatgttgg agtatcggct
7201 ctcctgctag cagccggatg ctggggacaa gtcactctca ccgtgacggt gacatcagca
7261 acacttctgt tctgccatta tgcctacatg gtacctggat ggcaggctga ggcaatgcgc
7321 tcagcccagc gacgaacagc cgctggaatc atgaaaaacg ctgtggtaga cggcatcgtg
7381 gccacggacg ttccagagct agagcgtacc acacccatca tgcagaagaa ggttggacaa
7441 gttatgctga ttttggtgtc tcttgccgca ttggtggtaa acccgtctgt gaagacagtg
7501 cgggaagccg gaattctgat tacggcagca gctgttaccc tctgggagaa cggagcaagc
7561 tctgtgtgga acgcaacaac cgccatagga ctttgtcaca tcatgcgcgg aggctggtta
7621 tcgtgtttat ccataacatg gactcttgta aaaaacatgg aaaaaccagg gctgaagaga
7681 ggtgggggcaa aaggacgcac cttgggggag gtttggaaag aaagacttaa ccagatgacg
7744 aaagaagaat tcatcaggta ccgtaaagaa gccatcactg aagttgaccg ctcagcagca
7801 aaacacgcta ggaaggaaag gaatatcact ggagggcatc cagtttctag aggcacggca
7861 aagctaagat ggctggtcga gaggaggttt cttgaaccgg tcggaaaagt gatcgaccct
7921 ggatgtggaa gaggcggctg gtgttattac atggccacac aaaaaaagagt ccaagaagtc
7981 agagggtaca caaaaggtgg tcccggacat gaagagcccc agctagtgca gagctatgga
8041 tggaacattg tcaccatgaa gagtggggtg gatgtgttct ataggccttc tgaatgttgt
8101 gacactctcc tttgtgatat cggagagtcc tcatcaagtg ctgaagttga agaacataga
8161 acgctacgag tccttgaaat ggtggaagac tggttgcatc gagggccaaa ggaattttgt
8221 gtgaaggtac tgtgccccta catgccaaag gtcatagaaa agatggagct gctccaacgc
8281 cggtatggcg ggggattggt taggaaccca ctctcacgga attccacaca tgaaatgtat
8341 tgggtgagtc gagcctcagg caatgtggtg cactcagtga acatgaccag ccaggtactc
8401 ttaggaagga tggagaagaa gacctggaag ggacctcagt acgaagaaga cgtgaacttg
8461 ggaagcggaa cgagagcagt gggaaaacct ctactcaact cagacaccag caagataaag
8521 aacaggattg aacgacttag gcgtgagtac agctcgacat ggcatcatga tgagaaccac
8581 ccatatagaa cctggaacta ccacggtagc tacgaagtga agccaacagg ctctgcaagc
8641 tcactggtca atggagtggt caggctcctc tcgaaaccat gggacaccat cacaaatgtc
8701 accacaatgg ccatgacgga caccaccccct tttggacaac agcgagtgtt caaagagaag
8761 gtggacacga aagctccgga accgccagaa ggagtgaagt atgtgctcaa tgaaaccacc
8821 aactggttgt gggcgttcct ggcacgagaa aagcgtccca atgtgtgctc gcgagaggaa
8881 tttataagga aggtcaatag taatgcagct ctgggcgcca tgtttgagga gcagaatcaa
8941 tggaggagtg ctagagaagc ggttgaagat ccaaaattct gggaaatggt ggatgaagag
9001 cgtgaggcgc acttacgcgg agaatgtcat acttgcattt acaacatgat gggaaagagg
9061 gagaaaaaac ccggagagtt tgggaaagcc aagggaagca gggccatctg gtttatgtgg
```

FIG. 54 cont.

```
9121 ctgggagctc gcttcctaga gtttgaggct ctgggcttc ttaatgagga ccactggctt
9181 ggaagaaaga actcgggggg cggggtcgag ggtctgggcc tccagaaatt aggctacatc
9241 ctgcgtgaag ttggcacccg acccggaggc agaatctacg ctgatgacac agccggttgg
9301 gacacccgca tcacaagagc tgacctggag aatgaagcca aggttcttga gttgttggac
9361 ggggagcacc ggcgcctggc cagggccatc attgagctca cctatcgcca caaagtagtg
9421 aaggtaatgc gcccggctgc tgatggaaga accgtcatgg acgtcatctc cagggaagac
9481 cagagaggaa gtgggcaagt tgtcacctac gctctaaaca cctttaccaa cctggctgtc
9541 caattggtga gaatgatgga aggagagggt gtgatcggcc cagatgatgt ggagaaactc
9601 acaaagggga aagggcccaa ggttagaacc tggctgtctg agaatgggga ggaaagactc
9661 agccgcatgg ctgtcagtgg agatgactgt gtggtaaagc ccttggatga tcgctttgcc
9721 acctctctcc actttctcaa cgccatgtca aaggtgcgca aggacatcca agagtggaaa
9781 ccatcaaccg gatggtatga ttggcagcaa gttccattct gttcaaacca cttcactgaa
9841 ctgatcatga aagatggaag aacactggtg actccatgcc gagggcagga tgagttagtg
9901 ggcagagctc gcatctcccc aggggctgga tggaatgttc gagacactgc ttgcttagcc
9961 aaatcttatg ctcagatgtg gttgctcctg tacttccaca gaagagatct gcggttgatg
10021 gccaacgcca tctgctctgc cgtacctgta aactgggtcc ctactggaag aaccacatgg
10081 tccatccacg ctggaggaga gtggatgaca acggaagaca tgctggaggt ctggaatcgt
10141 gtctggattg aggaaaatga atggatggag gacaaaaccc cagtggagaa gtggagtgat
10201 gttccatact ctggcaaacg agaggacatt tggtgtggca gcctgattgg cacaagagcc
10261 cgggccacgt gggcagaaaa cattcaagtg gccatcaacc aagtcagatc aataattgga
10321 gatgagaaat atgtggatta catgagttca ttgaagagat atgaagacac aacattggtt
10381 gaggatacag tattgtaaat actttgttaa ttgtaaataa atattgttat tatgtgtaga
10441 agtttagctt tataatagtg tttagtgtgt ttagagttag aaaaatttta gtgaggaagt
10501 caggccggaa aattcccgcc accggaagtt gagtagacgg tgctgcctgc gactcaaccc
10561 caggaggact gggtgaacaa agctgcgaag tgatccatgt aagccctcag aaccgtctcg
10621 gaaagaggac cccacatgtt gtagcttcaa ggcccaatgt cagaccacgc catggcgtgc
10681 cactctgcgg agagtgcagt ctgcgacagt gccccaggag gactgggtga acaaaggcga
10741 atcaacgtcc cacgcggccc tagctctggc aatggtgtta accagagtga aaggactaga
10801 ggttagagga gaccccgcgt tctgaagtgc acggcccagc ctggctgaag ctgtaggtca
10861 ggggaaggac tagaggttag tggagacccc gtgccgcaaa acaccacaac aacacagcat
10921 attgacacct gggatagact aggagatctt ctgctctgca caaccagcca cacggcacag
10981 tgcgccgaca atggtggctg gtggtgcgag aacacaggat ct
```

FIG. 54 cont.

SEQ ID NO:46    ZIKA genomic nucleotide sequence

```
   1 agttgttgat ctgtgtgaat cagactgcga cagttcgagt ttgaagcgaa agctagcaac
  61 agtatcaaca ggtttattt tggatttgga aacgagagtt tctggtcatg aaaaacccaa
 121 aaaagaaatc cggaggattc cggattgtca atatgctaaa acgcggagta gcccgtgtga
 181 gcccctttgg gggcttgaag aggctgccag ccggacttct gctgggtcat gggcccatca
 241 ggatggtctt ggcaattcta gccttttga gattcacggc aatcaagcca tcactgggtc
 301 tcatcaatag atggggttca gtggggaaaa aagaggctat ggaaataata aagaagttca
 361 agaaagatct ggctgccatg ctgagaataa tcaatgctag gaaggagaag aagagacgag
 421 gcgcagatac tagtgtcgga attgttggcc tcctgctgac cacagctatg gcagcggagg
 481 tcactagacg tgggagtgca tactatatgt acttggacag aaacgatgct ggggaggcca
 541 tatcttttcc aacccacattg gggatgaata agtgttatat acagatcatg gatcttggac
 601 acatgtgtga tgccaccatg agctatgaat gccctatgct ggatgagggg gtggaaccag
 661 atgacgtcga ttgttggtgc aacacgacgt caacttgggt tgtgtacgga acctgccatc
 721 acaaaaaagg tgaagcacgg agatctagaa gagctgtgac gctccctcc cattccacta
 781 ggaagctgca acgcggtcg caaacctggt tggaatcaag agaatacaca aagcacttga
 841 ttagagtcga aaattggata ttcaggaacc ctggcttcgc gttagcagca gctgccatcg
 901 cttggctttt gggaagctca acgagccaaa aagtcatata cttggtcatg atactgctga
 961 ttgccccggc atacagcatc aggtgcatag gagtcagcaa tagggacttt gtggaaggta
1021 tgtcaggtgg gacttgggtt gatgttgtct tggaacatgg aggttgtgtc accgtaatgg
1081 cacaggacaa accgactgtc gacatagagc tggttacaac aacagtcagc aacatggcgg
1141 aggtaagatc ctactgctat gaggcatcaa tatcagacat ggcttcggac agccgctgcc
1201 caacacaagg tgaagcctac cttgacaagc aatcagacac tcaatatgtc tgcaaaagaa
1261 cgttagtgga cagaggctgg ggaaatggat gtggactttt tggcaaaggg agcctggtga
1321 catgcgctaa gtttgcatgc tccaagaaaa tgaccgggaa gagcatccag ccagagaatc
1381 tggagtaccg gataatgctg tcagttcatg gctcccagca cagtgggatg atcgttaatg
1441 acacaggaca tgaaactgat gagaatagag cgaaggttga gataacgccc aattcaccaa
1501 gagccgaagc caccctgggg ggttttggaa gcctaggact tgattgtgaa ccgaggacag
1561 gccttgactt ttcagatttg tattacttga ctatgaataa caagcactgg ttggtccaca
1621 aggagtggtt ccacgacatt ccattacctt ggcacgctgg ggcagacacc ggaactccac
1681 actggaacaa caaagaagca ctggtagagt tcaaggacgc acatgccaaa aggcaaactg
1741 tcgtggttct agggagtcaa gaaggagcag ttcacacggc ccttgctgga gctctggagg
1801 ctgagatgga tggtgcaaag ggaaggctgt cctctggcca cttgaaatgt cgcctgaaaa
1861 tggataaact tagattgaag ggcgtgtcat actccttgtg taccgcagcg ttcacattca
1921 ccaagatccc ggctgaaaca ctgcacggga cagtcacagt ggaggtacag tacgcaggga
1981 cagatggacc ttgcaaggtt ccagctcaga tggcggtgga catgcaaact ctgaccccag
2041 ttgggaggtt gataaccgct aaccccgtaa tcactgaaag cactgagaac tctaagatga
2101 tgctggaact tgatccacca tttgggact cttacattgt cataggagtc ggggagaaga
2161 agatcaccca ccactggcac aggagtggca gcaccattgg aaaagcattt gaagccactg
2221 tgagaggtgc caagagaatg gcagtcttgg gagacacagc ctgggactt ggatcagttg
2281 gaggcgctct caactcattg ggcaagggca tccatcaaat ttttggagca gctttcaaat
2341 cattgtttgg aggaatgtcc tggttctcac aaatcctcat tggaacgttg ctgatgtggt
2401 tgggtctgaa cacaaagaat ggatctattt cccttatgtg cttggcctta gggggagtgt
2461 tgatcttctt atccacagcc gtctctgctg atgtggggtg ctcggtggac ttctcaaaga
2521 aggagacgag atgcggtaca gggtgttcg tctataacga cgttgaagcc tgagggggaca
2581 ggtacaagta ccatcctgac tccccccgta gattggcagc agcagtcaag caagcctggg
2641 aagatggtat ctgcgggatc tcctctgttt caagaatgga gaacatcatg tggagatcag
2701 tagaagggga gctcaacgca atcttggaag agaatggagt tcaactgacg gtcgttgtgg
2761 gatctgtaaa aaaccccatg tggagaggtc acagagatt gccccgtgcct gtgaacgagc
2821 tgccccacgg ctggaaggct tggggaaat cgtacttcgt cagagcagca aagacaaata
2881 acagctttgt cgtggatggt gacacactga aggaatgccc actcgaacat agagcatgga
2941 acagctttct gtggaggat catgggttcg ggtatttca cactagtgtc tggctcaagg
```

FIG. 55

```
3001 ttagagaaga ttattcatta gagtgtgatc cagccgttat tggaacagct gttaagggga
3061 aggaggctgt acacagtgat ctaggctact ggattgagag tgagaagaat gacacatgga
3121 ggctgaagag ggcccatcta atcgagatga aaacatgtga atggccaaag tcccacacat
3181 tgtgggcaga tggaatagaa gagagtgatc tgatcattcc caagtcttta gctgggccac
3241 tcagccatca caataccaga gagggctaca ggacccaaat gaaagggcca tggcacagtg
3301 aagagcttga aattcggttt gaggaatgcc cgggcactaa ggtccacgtg gaggaaacat
3361 gtggaacaag aggaccatct ctgagatcaa ccactgcaag cggaagggtg atcgaggaat
3421 ggtgctgcag ggagtgcaca atgcccccac tgtcgttccg ggctaaagat ggctgttggt
3481 atggaatgga gataaggccc aggaaagaac cagaaagcaa cttagtaagg tcagtggtga
3541 ctgcaggatc aactgatcac atggatcact tctcccttgg agtgcttgtg attctgctca
3601 tggtgcagga agggctgaag aagagaatga ccacaaagat catcataagc acatcaatgg
3661 cagtgctggt agctatgatc ctgggaggat tttcaatgag tgacctggct aagcttgcaa
3721 ttttgatggg cgccaccttc gcggaaatga acactggagg agatgtagct catctggcgc
3781 tgatagcggc attcaaagtc agaccagcgt tgctggtatc tttcatcttc agagctaatt
3841 ggacaccccg tgaaagcatg ctgctggcct tggcctcgtg tcttttgcaa actgcgatct
3901 ccgccttgga aggcgacctg atggttctca tcaatggttt tgctttggcc tggttggcaa
3961 tacgagcgat ggttgttcca cgcactgata acatccacctt ggcaatcctg ctgctctga
4021 caccactggc ccgggggcaca ctgcttgtgg cgtggagagc aggccttgct acttgcgggg
4081 ggtttatgct cctctctctg aagggaaaag gcagtgtgaa gaagaactta ccatttgtca
4141 tggccctggg actaaccgct gtgaggctgg tcgacccat caacgtggtg ggactgctgt
4201 tgctcacaag gagtgggaag cggagctggc cccctagcga agtactcaca gctgttggcc
4261 tgatatgcgc attggctgga gggttcgcca aggcagatat agatggct gggcccatgg
4321 ccgcggtcgg tctgctaatt gtcagttacg tggtctcagg aaagagtgtg gacatgtaca
4381 ttgaaagagc aggtgacatc acatgggaaa aagatgcgga agtcactgga aacagtcccc
4441 ggctcgatgt ggcgctagat gagagtggtg atttctccct ggtggaggat gacggtcccc
4501 ccatgagaga gatcatactc aaggtggtcc tgatgaccat ctgtggcatg aacccaatag
4561 ccataccctt tgcagctgga gcgtggtacg tatacgtgaa gactggaaaa aggagtggtg
4621 ctctatggga tgtgcctgct cccaaggaag taaaaaaggg ggagaccaca gatggagtgt
4681 acagagtaat gactcgtaga ctgctaggtt caacacaagt tggagtggga gttatgcaag
4741 aggggggtctt tcacactatg tggcacgtca caaaaggatc cgcgctgaga agcggtgaag
4801 ggagacttga tccatactgg ggagatgtca agcaggatct ggtgtcatac tgtggtccat
4861 ggaagctaga tgccgcctgg gacgggcaca gcgaggtgca gctcttggcc gtgccccccg
4921 gagagagagc gaggaacatc cagactctgc ccggaatatt taagacaaag gatggggaca
4981 ttggagcggt tgcgctggat tacccagcag gaacttcagg atctccaatc ctagacaagt
5041 gtgggagagt gataggactt tatggcaatg gggtcgtgat caaaaatggg agttatgtta
5101 gtgccatcac ccaagggagg agggaggaag agactcctgt tgagtgcttc gagccttcga
5161 tgctgaagaa gaagcagcta actgtcttag acttgcatcc tggagctggg aaaaccagga
5221 gagttcttcc tgaaatagtc cgtgaagcca taaaaacaag actccgtact gtgatcttag
5281 ctccaaccag ggttgtcgct gctgaaatgg aggaagccct tagagggctt ccagtgcgtt
5341 atatgacaac agcagtcaat gtcacccact ctggaacaga aatcgtcgac ttaatgtgcc
5401 atgccacctt cacttcacgt ctactacagc caatcagagt ccccaactat aatctgtata
5461 ttatggatga ggcccacttc acagatccct caagtatagc agcaagagga tacatttcaa
5521 caagggttga gatgggcgag gcggctgcca tcttcatgac cgccacgcca ccaggaaccc
5581 gtgacgcatt tccggactcc aactcaccaa ttatggacac cgaagtggaa gtcccagaga
5641 gagcctggag ctcaggcttt gattgggtga cggatcattc tggaaaaaca gtttggtttg
5701 ttccaagcgt gaggaacggc aatgagatcg cagcttgtct gacaaaggct ggaaaacggg
5761 tcatacagct cagcagaaag actttgaga cagagttcca gaaaacaaaa catcaagagt
5821 gggacttgt cgtgacaact gacatttcag agatgggcgc caactttaaa gctgaccgtg
5881 tcatagattc caggagatgc ctaaagccgg tcatacttga tggcgagaga gtcattttgg
5941 ctggacccat gcctgtcaca catgccagcg ctgcccagag gaggggcgc ataggcagga
6001 atccccaacaa acctggagat gagtatctgt atggaggtgg gtgcgcagag actgacgaag
```

FIG. 55 cont.

6061 accatgcaca ctggcttgaa gcaagaatgc tccttgacaa tatttacctc caagatggcc
6121 tcatagcctc gctctatcga cctgaggccg acaaagtagc agccattgag ggagagttca
6181 agcttaggac ggagcaaagg aagacctttg tggaactcat gaaaagagga gatcttcctg
6241 tttggctggc ctatcaggtt gcatctgccg gaataaccta cacagataga agatggtgct
6301 ttgatggcac gaccaacaac accataatgg aagacagtgt gccggcagag gtgtggacca
6361 gacacggaga gaaaagagtg ctcaaaccga ggtggatgga cgccagagtt tgttcagatc
6421 atgcggccct gaagtcattc aaggagtttg ccgctgggaa aagaggagcg gcttttggag
6481 tgatggaagc cctgggaaca ctgccaggac acatgacaga gagattccag gaagccattg
6541 acaacctcgc tgtgctcatg cgggcagaga ctggaagcag gccttacaaa gccgcggcgg
6601 cccaattgcc ggagacccta gagaccatta tgcttttggg gttgctggga acagtctcgc
6661 tgggaatctt tttcgtcttg atgaggaaca agggcatagg gaagatgggc tttggaatgg
6721 tgactcttgg ggccagcgca tggctcatgt ggctctcgga aattgagcca gccagaattg
6781 catgtgtcct cattgttgtg ttcctattgc tggtggtgct catacctgag ccagaaaagc
6841 aaagatctcc ccaggacaac caaatggcaa tcatcatcat ggtagcagta ggtcttctgg
6901 gcttgattac cgccaatgaa ctcggatggt tggagagaac aaagagtgac ctaagccatc
6961 taatgggaag gagagaggag ggagcaacca taggattctc aatggacatt gacctgcggc
7021 cagcctcagc ttgggccatc tatgctgcct tgacaacttt cattacccca gccgtccaac
7081 atgcagtgac cacttcatac aacaactact ccttaatggc gatggccacg caagctggag
7141 tgttgtttgg tatgggcaaa gggatgccat tctacgcatg ggactttgga gtcccgctgc
7201 taatgatagg ttgctactca caattaacac ccctgaccct aatagtggcc atcattttgc
7261 tcgtggcgca ctacatgtac ttgatcccag gctgcaggc agcagctgcg cgtgctgccc
7321 agaagagaac ggcagctggc atcatgaaga accctgttgt ggatggaata gtggtgactg
7381 acattgacac aatgacaatt gacccccaag tggagaaaaa gatgggacag tgctactca
7441 tagcagtagc agtctccagc gccatactgt cgcggaccgc ctgggggtgg gggaggctg
7501 gggccctgat cacagccgca acttccactt tgtgggaagg ctctccgaac aagtactgga
7561 actcctctac agccacttca ctgtgtaaca tttttagggg aagttacttg gctggagctt
7621 ctctaatcta catagtaaca agaaacgctg gcttggtcaa gagacgtggg ggtggaacag
7681 gagagaccct gggagagaaa tggaaggccc gcttgaacca gatgtcggcc ctggagttct
7741 actcctacaa aaagtcaggc atcaccgagg tgtgcagaga agaggcccgc cgcgccctca
7801 aggatggtgt ggcaacggga ggccatgctg tgtcccgagg aagtgcaaag ctgagatggt
7861 tggtggagcg gggatacctg cagccctatg gaaaggtcat tgatcttgga tgtggcagag
7921 ggggctggag ttactacgcc gccaccatcc gcaaagttca agaagtgaaa ggatacacaa
7981 aaggaggccc tggtcatgaa gaacccgtgt tggtgcaaag ctatgggtgg aacatagtcc
8041 gtcttaagag tggggtggac gtctttcata tggcggctga gccgtgtgac acgttgctgt
8101 gtgacatagg tgagtcatca tctagtcctg aagtggaaga agcacggacg ctcagagtcc
8161 tctccatggt gggggattgg cttgaaaaaa gaccaggagc cttttgtata aaagtgttgt
8221 gcccatacac cagcactatg atggaaaccc tggagcgact gcagcgtagg tatgggggag
8281 gactggtcag agtgccactc tcccgcaact ctacacatga atgtactgg gtctctggag
8341 cgaaaagcaa caccataaaa agtgtgtcca ccacgagcca gctcctcttg gggcgcatgg
8401 acgggcctag gaggccagtg aaatatgagg aggatgtgaa tctcggctct ggcacgcggg
8461 ctgtggtaag ctgcgctgaa gctcccaaca tgaagatcat tggtaaccgc attgaaagga
8521 tccgcagtga gcacgcggaa acgtggttct ttgacgagaa ccaccatat aggacatggg
8581 cttaccatgg aagctatgag gccccacac aagggtcagc gtcctctcta ataaacgggg
8641 ttgtcaggct cctgtcaaaa ccctgggatg tggtgactgg agtcacagga atagccatga
8701 ccgacaccac accgtatggt cagcaaagag ttttcaagga aaaagtggac actagggtgc
8761 cagaccccca agaaggcact cgtcaggtta tgagcatggt ctcttcctgg ttgtggaaag
8821 agctaggcaa acacaaacgg ccacgagtct gtaccaaaga agagttcatc aacaaggttc
8881 gtagcaatgc agcattaggg gcaatatttg aagaggaaaa agagtggaag actgcagtgg
8941 aagctgtgaa cgatccaagg ttctgggctc tagtggacaa ggaaagagag caccacctga
9001 gaggagagtg ccagagttgt gtgtacaaca tgatgggaaa agagagaaag aaacaagggg
9061 aatttggaaa ggccaagggc agccgcgcca tctggtatat gtggctaggg gctagatttc

FIG. 55 cont.

9121 tagagttcga agcccttgga ttcttgaacg aggatcactg gatggggaga gagaactcag
9181 gaggtggtgt tgaagggctg ggattacaaa gactcggata tgtcctagaa gagatgagtc
9241 gcataccagg aggaaggatg tatgcagatg acactgctgg ctgggacacc cgcatcagca
9301 ggttcgatct ggagaatgaa gctctaatca ccaaccaaat ggagaaaggg catagggcct
9361 tggcattggc cataatcaag tacacatacc aaaacaaagt ggtaaaggtc cttagaccag
9421 ctgaaaaagg gaaaacagtt atggacatta tttcgagaca agaccaaagg gggagcggac
9481 aagttgtcac ttacgctctt aacacattta ccaacctagt ggtgcaactc attcggaata
9541 tggaggctga ggaagttcta gagatgcaag acttgtggct gctgcggagg tcagagaaag
9601 tgaccaactg gttgcagagc aacggatggg ataggctcaa acgaatggca gtcagtggag
9661 atgattgcgt tgtgaagcca attgatgata ggtttgcaca tgccctcagg ttcttgaatg
9721 atatgggaaa agttaggaag gacacacaag agtggaaacc ctcaactgga tgggacaact
9781 gggaagaagt tccgtttttgc tcccaccact tcaacaagct ccatctcaag gacgggaggt
9841 ccattgtggt tccctgccgc caccaagatg aactgattgg ccgggcccgc gtctctccag
9901 gggcgggatg gagcatccgg gagactgctt gcctagcaaa atcatatgcg caaatgtggc
9961 agctccttta tttccacaga agggacctcc gactgatggc caatgccatt tgttcatctg
10021 tgccagttga ctgggttcca actgggagaa ctacctggtc aatccatgga aagggagaat
10081 ggatgaccac tgaagacatg cttgtggtgt ggaacagagt gtggattgag gagaacgacc
10141 acatggaaga caagaccccca gttacgaaat ggacagacat tccctatttg ggaaaaaggg
10201 aagacttgtg gtgtggatct ctcatagggc acagaccgcg caccacctgg gctgagaaca
10261 ttaaaaacac agtcaacatg gtgcgcagga tcataggtga tgaagaaaag tacatggact
10321 acctatccac ccaagttcgc tacttgggtg aagaagggtc tacacctgga gtgctgtaag
10381 caccaatctt aatgttgtca ggcctgctag tcagccacag cttggggaaa gctgtgcagc
10441 ctgtgacccc cccaggagaa gctgggaaac caagcctata gtcaggccga gaacgccatg
10501 gcacggaaga agccatgctg cctgtgagcc cctcagagga cactgagtca aaaaccccca
10561 tgcgcttgga ggcgcaggat gggaaaagaa ggtggcgacc ttccccaccc ttcaatctgg
10621 ggcctgaact ggagatcagc tgtggatctc cagaagaggg actagtggtt agaggagacc
10681 ccccggaaaa cgcaaaacag catattgacg ctgggaaaga ccagagactc catgagtttc
10741 caccacgctg gccgccaggc acagatcgcc gaatagcggc ggccggtgtg gggaaatcca
10801 tgggtctt

FIG. 55 cont.

SEQ ID NO:47  DENV2 genomic nucleotide sequence

```
   1 agttgttagt ctacgtggac cgacaaagac agattctttg agggagctaa gctcaacgta
  61 gttctaactg ttttttgatt agagagcaga tctctgatga ataaccaacg gaaaaaggcg
 121 agaaacacgc ctttcaatat gctgaaacgc gagagaaacc gcgtgtcaac tgtacaacag
 181 ttgacaaaga gattctcact tggaatgctg cagggacgag gaccactaaa attgttcatg
 241 gccctggtgg cattccttcg tttcctaaca atcccaccaa cagcagggat attaaaaaga
 301 tgggggaacaa ttaaaaaatc aaaggctatt aatgttctga gaggcttcag gaaagagatt
 361 ggaaggatgc tgaatatctt aaacaggaga cgtagaactg caggcatgat catcatgctg
 421 attccaacag tgatggcgtt tcatctgacc acacgcaacg gagaaccaca catgatcgtc
 481 agtagacaag aaaaagggaa aagccttctg tttaagacaa aggacggcac gaacatgtgt
 541 accctcatgg ccatggacct tggtgagttg tgtgaagaca caatcacgta taatgtcct
 601 tttctcaagc agaacgaacc agaagacata gattgttggt gcaactccac gtccacatgg
 661 gtaacttatg gacatgtac caccacagga gagcacagaa gagaaaaaag atcagtggcg
 721 cttgttccac acgtgggaat gggattgag acacgaactg aaacatggat gtcatcagaa
 781 ggggcctgga acatgccca gagaattgaa acttggattc tgagacatcc aggctttacc
 841 ataatggccg caatcctggc atacaccata ggaacgacgc atttccaaag agtcctgata
 901 ttcatcctac tgacagccat cgctccttca atgacaatgc gctgcatagg aatatcaaat
 961 agggactttg tggaaggagt gtcaggaggg agttgggttg acatagtttt agaacatgga
1021 agttgtgtga cgacgatggc aaaaaataaa ccaacactgg actttgaact gataaaaaca
1081 gaagccaaac aacccgccac cttaaggaag tactgtatag aggctaaact gaccaacacg
1141 acaacagact cgcgctgccc aacacaaggg gaacccaccc tgaatgaaga gcaggacaaa
1201 aggtttgtct gcaaacattc catggtagac agaggatggg gaaatggatg tggattattt
1261 ggaaaaggag gcatcgtgac ctgtgctatg ttcacatgca aaagaacat ggaaggaaaa
1321 attgtgcagc cagaaaacct ggaatacact gtcgtgataa cacctcattc agggggaagaa
1381 catgcagtcg gaaatgacac aggaaaacat ggtaaagaag tcaagataac accacagagc
1441 tccatcacag aggcggaact gacaggctat ggcactgtta cgatggagtg ctctccaaga
1501 acgggcctcg acttcaatga gatggtgttg ctgcaaatga agacaaagc ttggctggtg
1561 cacagacaat ggttcctaga cctaccgttg ccatggctgc ccggagcaga cacacaagga
1621 tcaaattgga tacagaaaga gacactggtc accttcaaaa atccccatgc gaaaaaacag
1681 gatgttgttg tcttaggatc ccaagagggg gccatgcata cagcactcac aggggctacg
1741 gaaatccaga tgtcatcagg aaacctgctg ttcacaggac atctcaagtg caggctgaga
1801 atggacaaat acaacttaa agggatgtca tactccatgt gcacaggaaa gtttaaaatt
1861 gtgaaggaaa tagcagaaac acaacatgga acaatagtca ttagagtaca atatgaagga
1921 gacggctctc catgcaagat ccccttgag ataatggatc tggaaaaaag acatgttttg
1981 ggccgcctga tcacagtcaa cccaattgta acagaaaagg acagtccagt caacatagaa
2041 gcagaacctc cattcggaga cagctacatc atcataggag tggaaccagg acaattgaag
2101 ctggactggt tcaagaaagg aagttccatc ggccaaatgt ttgagacaac aatgagggga
2161 gcgaaaagaa tggccatttt gggcgacaca gcctgggatt tggatctct ggaggagtg
2221 ttcacatcaa taggaaaggc tctccaccag gttttgag caatctacgg ggctgctttc
2281 agtgggggtct catggactat gaagatcctc ataggagtta tcatcacatg gataggaatg
2341 aactcacgta gcacatcact gtctgtgtca ctggtattag tgggaatcgt gacactgtac
2401 ttgggagtta tggtgcaggc cgatagtggt tgcgttgtga gctggaagaa caaagaacta
2461 aaatgtggca gtggaatatt cgtcacagat aacgtgcata catggacaga acaatacaag
2521 ttccaaccag aatcccttc aaaactggct tcagccatcc agaaagctca tgaagagggc
2581 atctgtggaa tccgctcagt aacaagactg gaaaatctta tgtggaaaca gataacatca
2641 gaattgaatc atattctatc agaaaatgaa gtgaaactga ccatcatgac aggagacatc
2701 aaaggaatca tgcaggtagg aaaacgatct ctgcggcctc aacccactga gttgaggtat
2761 tcatggaaaa catggggtaa agcgaaaacg ctctccacag aactccacaa tcagaccttc
2821 ctcattgatg gtcccgaaac agcagaatgc cccaacacaa acagagcttg gaattcacta
2881 gaagttgagg actacggctt tggagtattc actaccaata tatggctaag attgagagaa
2941 aagcaggatg tatttttgtga ctcaaaactc atgtcagcgg ccataaagga caacagagcc
```

FIG. 56

```
3001 gtccatgctg atatgggtta ttggatagaa agcgcactca atgatacatg gaagatagag
3061 aaagcttctt tcattgaagt caaaagttgc cactggccaa agtcacacac tctatggagt
3121 aatggagtgc tagaaagcga gatggtaatt ccaaagaatt tcgctggacc agtgtcacaa
3181 cataataaca gaccaggcta tcacacacaa acagcaggac ctttggcatct aggcaagctt
3241 gagatggact ttgatttctg cgaagggact acagtggtgg taaccgagga ctgtggaaac
3301 agagggcctt ctttaagaac aaccactgcc tcaggaaaac tcataacgga atggtgttgt
3361 cgatcttgca cactaccacc actaagatac agaggtgagg atggatgctg gtacgggatg
3421 gaaatcagac cattgaaaga gaaagaagaa aatctggtca gttctctggt cacagccgga
3481 catgggcaga ttgataattt ctcattagga atcttgggaa tggcactgtt ccttgaagaa
3541 atgctcagga ctcgagtagg aacgaaacat gcaatattac tagtcgcagt ttctttcgta
3601 acgttaatca cagggaacat gtctttttaga gacctgggaa gagtgatggt tatggtgggt
3661 gccaccatga cagatgacat aggcatgggt gtgacttatc ttgctctact agcagctttc
3721 aaagtcagac caacctttac agctggactg ctcttgagaa aactgacctc caaggaatta
3781 atgatgacca ccataggaat cgttcttctc tcccagagta gcataccaga gaccattctt
3841 gaactgaccg atgcgttagc tttaggcatg atggtcctca agatggtgag aaacatggaa
3901 aaatatcagc tggcagtgac tatcatggct attttgtgcg tcccaaatgc tgtgatatta
3961 cagaacgcat ggaaagtgag ttgcacaata ttggcagtgg tgtctgtttc cccctgctc
4021 ttaacatcct cacaacagaa agcggactgg ataccattag cgttgacgat caaaggcctc
4081 aatccaacag ccattttct aacaaccctc tcaagaacca gcaagaaaag gagctggcct
4141 ttaaatgagg ccatcatggc ggttgggatg gtgagtatct tggccagctc tctcttaaag
4201 aatgacatcc ccatgacagg accattagtg gctggagggc ttcttactgt gtgctacgta
4261 ctaactgggc ggtcagccga tctgaaacta gagagagcta ccgatgtcaa atgggatgac
4321 caggcagaga tatcaggtag cagtccaatt ctgtcaataa caatatcaga agatggcagc
4381 atgtcaataa agaatgaaga ggaagagcaa acactgacta tactcattag aacaggattg
4441 cttgtgatct caggactctt tccggtatca ataccaatca cagcagcagc atggtacctg
4501 tgggaagtaa agaaacaacg ggctggagtg ttgtgggatg tccctcacc accaccgtg
4561 ggaaaggctg aattggaaga tggagcctac agaatcaagc aaaaaggaat ccttggatat
4621 tcccagatcg gagctggagt ttacaaagaa ggaacatttc acacaatgtg gcacgtcaca
4681 cgtggcgctg tcctaatgca taagggggaag aggattgaac catcatgggc ggacgtcaag
4741 aaagacttaa tatcatatgg aggaggttgg agctagaag gagaatggaa agaaggagaa
4801 gaagtccagg tcttggcatt ggagcctggg aaaaatccaa gagccgtcca aacaaaacct
4861 ggcctttta gaaccaatac tggaaccata ggtgccgtat ctctggactt ttcccctggg
4921 acgtcaggat ctccaatcgt cgacaaaaaa ggaaaagttg taggtctcta tggcaatggt
4981 gtcgttacaa ggagtggagc atatgtgagt gccatagctc agactgaaaa aagcattgaa
5041 gacaatccag agattgaaga tgacatcttt cgaaagagaa gattgaccat catggatctc
5101 cacccaggag caggaaagac aaagagatac ctcccggcca tagtcagaga ggccataaaa
5161 agaggcttga gaacactaat cctagccccc actagagtcg tggcagctga aatggaggaa
5221 gcccttagag gacttccaat aagataccaa actccagcta tcagggctga gcacaccggg
5281 cgggagattg tggacttaat gtgtcatgcc acatttacca tgaggctgct atcaccaatc
5341 agggtgccaa attcaacct gatcatcatg gacgaagccc attttacaga tccagcaagc
5401 atagcagcta ggggatacat ctcaactcga gtggagatgg gtgaggcagc tggaattttt
5461 atgacagcca ctcctccggg tagcagagat ccatttcctc agagtaatgc accaattatg
5521 gacgaagaaa gagaaattcc ggaacgttca tggaactccg ggcacgagtg ggtcacggat
5581 tttaaaggaa agactgtctg gtttgttcca agcataaaaa ccggaaatga catagcagcc
5641 tgcctgagaa agaatggaaa gagggtgata caactcagta ggaagacctt tgattctgaa
5701 tatgtcaaga ctagaaccaa tgactgggat ttcgtggtta caactgacat ctcggaaatg
5761 ggtgccaact ttaaagctga gagggttata gaccccagac gctgcatgaa accagttata
5821 ctgacagacg gcgaagagcg ggtgattctg gcaggaccca tgccagtgac ccactctagt
5881 gcagcacaaa gaagagggag aataggaagg aatccaagga atgaaaatga tcaatatata
5941 tatatggggg aacccctgga aaatgatgaa gactgtgcgc actggaagga agctaagatg
6001 ctcctagata acatcaacac acctgaagga atcattccca gcatgttcga gccagagcgt
```

FIG. 56 cont.

6061 gaaaaggtgg atgccattga cggtgaatat cgcttgagag gagaagcacg gaaaactttt
6121 gtggacctaa tgagaagagg agacctacca gtctggttgg cttataaagt ggcagctgaa
6181 ggtatcaact acgcagacag aagatggtgt tttgacggaa ccagaaacaa tcaaatcttg
6241 gaagaaaatg tggaagtgga aatctggaca aaggaagggg aaaggaaaaa attgaaacct
6301 agatggttag atgctaggat ctactccgac ccactggcgc taaaagaatt caaggaattc
6361 gcagccggaa gaaagtccct aaccctgaac ctaatcacag agatgggcag actcccaact
6421 tttatgactc agaaggccag agatgcacta gacaacttgg cggtgctgca cacggctgaa
6481 gcggtggaa aggcatacaa tcatgctctc agtgaactac cggagaccct ggagacattg
6541 cttttgctga cactgttggc cacagtcacg ggaggaatct ttctattcct gatgagcgga
6601 aggggtatag ggaagatgac cctgggaatg tgctgcataa tcacggccag catcctctta
6661 tggtatgcac aaatacaacc acattggata gcagcttcaa taatattgga gttctttctc
6721 atagtcttgc tcattccaga accagaaaag cagaggacac cccaggataa tcaattgact
6781 tatgtcatca tagccatcct cacagtggtg gccgcaacca tgcaaacga aatgggtttt
6841 ctggaaaaaa caaagaaaga cctcggactg ggaaacattg caactcagca acctgagagc
6901 aacattctgg acatagatct acgtcctgca tcagcatgga cgttgtatgc cgtggctaca
6961 acatttatca caccaatgtt gagacatagc attgaaaatt cctcagtaaa tgtgtccta
7021 acagccatag ctaaccaagc cacagtgcta atgggtctcg ggaaaggatg gccattgtca
7081 aagatggaca ttggagttcc cctccttgct attgggtgtt actcacaagt caaccctata
7141 acctcacag cggctcttct tttattggta gcacattatg ccatcatagg accgggactt
7201 caagccaaag caaccagaga agctcagaaa agagcagcag cgggcatcat gaaaaaccca
7261 actgtggatg gaataacagt gatagatcta gatccaatac cctatgatcc aaagtttgaa
7321 aagcagttgg gacaagtaat gctcctagtc ctttgcgtga cccaagtgct gatgatgagg
7381 actacgtggg ctttgtgtga agccttaact ctagcaaccg gacccgtgtc cacattgtgg
7441 gaaggaaatc cagggagatt ctggaacaca accattgcag tgtcaatggc aaacatcttt
7501 agagggagtt acctggctgg agctggactt ctcttttcta tcatgaagaa cacaaccagc
7561 acgagaagag gaactggcaa cataggagaa acgctaggag agaaatggaa aagcagactg
7621 aacgcattgg ggaaaagtga attccagatc tacaaaaaaa gtggaattca agaagtggac
7681 agaaccttag caaaagaagg cattaaaaga ggagaaacgg atcatcacgc tgtgtcgcga
7741 ggctcagcaa aactgagatg gttcgttgaa agaaatttgg tcacaccaga agggaaagta
7801 gtggaccttg gttgcggtag aggggctgg tcatactatt gtggaggatt aaagaatgta
7861 agagaagtta aaggcttaac aaaaggagga ccaggacacg aagaacctat ccctatgtca
7921 acatatgggt ggaatctagt acgcttacag agcggagttg acgtcttttt tgttccacca
7981 gagaagtgtg acacattgtt gtgtgacata ggggaatcat caccaaatcc cacggtagaa
8041 gcgggacgaa cactcagagt ccttaaccta gtggaaaatt ggctgaacaa taacccccaa
8101 ttttgcgtaa aggttcttaa cccgtacatg ccctcagtca ttgaaagaat ggaaaccttg
8161 caacggaaat acggaggagc cttggtgaga aatccactct cacggaattc cacacatgag
8221 atgtactggg tgtccaatgc ttccgggaac atagtgtcat cagtgaacat gatttcaaga
8281 atgctgatta acagattcac catgagacac aagaaggcca cctatgagcc agatgtcgac
8341 ctcggaagcg gaacccgcaa tattggaatt gaagtgagaa caccgaacct agacataatt
8401 gggaaaagaa tagaaaaaat aaaacaagag catgaaacgt catggcacta tgaccaagac
8461 cacccataca aaacatgggc ttaccatggc agctatgaaa caaacagac tggatcagca
8521 tcatccatgg tgaacggagt agtcagattg ctgacaaaac cctgggacgt tgttccaatg
8581 gtgacacaga tggcaatgac agacacaact cctttcggac aacagcgcgt cttcaaagag
8641 aaggtggata cgagaaccca agaaccaaaa gaaggcacaa aaaaactaat gaaaatcacg
8701 gcagagtggc tctggaaaga actaggaaag aaaaagacac ctagaatgtg caccagagaa
8761 gaattcacaa aaaaggtgag aagcaatgca gccttggggg ccatatttac cgatgagaac
8821 aagtggaaat cggcgcgtga ggctgttgaa gatagtaggt ttgggagct ggttgacaag
8881 gaaagaaacc tccatcttga agggaaatgt gaaacatgtg tatacaacat gatgggaaaa
8941 agagagaaaa aactaggaga gtttggtaaa gcaaaaggca gcagagccat atggtacatg
9001 tggctcggag cacgcttctt agagtttgaa gccctaggat tttgaatga agaccattgg
9061 ttctccagag agaactccct gagtggagtg gaaggagaag ggctgcataa gctaggttac

FIG. 56 cont.

```
9121 atcttaagag aggtgagcaa gaaagaagga ggagcaatgt atgccgatga caccgcaggc
9181 tgggacacaa gaatcacaat agaggattta aaaaatgaag aaatgataac gaaccacatg
9241 gcaggagaac acaagaaact tgccgaggcc atttttaaat tgacgtacca aaacaaggtg
9301 gtgcgtgtgc aaagaccaac accaagaggc acagtaatgg acatcatatc gagaagagac
9361 caaaggggta gtggacaagt tggcacctat ggcctcaaca ctttcaccaa catggaagca
9421 caactaatta ggcaaatgga gggggaagga atcttcaaaa acatccagca cttgacagcc
9481 tcagaagaaa tcgctgtgca agattggcta gtaagagtag ggcgtgaaag gttgtcaaga
9541 atggccatca gtgagatga ttgtgttgtg aaacctttag atgatagatt tgcaagagct
9601 ctaacagctc taaatgacat gggaaaggtt aggaaggaca tacagcaatg ggagccctca
9661 agaggatgga acgactggac acaggtgccc ttctgttcac accattttca cgagttaatt
9721 atgaaagatg gtcgcacact cgtagttcca tgcagaaacc aagatgaatt gatcggcaga
9781 gcccgaattt cccagggagc tgggtggtct ttacgggaga cggcctgttt ggggaagtct
9841 tacgcccaaa tgtggagctt gatgtacttc cacagacgtg atctcaggct agcggcaaat
9901 gccatctgct cggcagtccc gtcacactgg gttccaacaa gccggacaac ctggtccata
9961 cacgccagcc atgaatggat gacgacggaa gacatgttga cagtttggaa caaagtatgg
10021 atcctagaaa atccatggat ggaagacaaa actccagtgg aatcatggga ggaaatccca
10081 tacctgggaa aaagagaaga ccaatggtgc ggctcactga ttgggctgac aagcagagcc
10141 acctgggcga agaatatcca gacagcaata aaccaagtca gatccctcat tggcaatgag
10201 gaatacacag attacatgcc atccatgaaa agattcagaa gagaagagga agaggcagga
10261 gttttgtggt agaaaaacat gaaacaaaac agaagtcagg tcggattaag ccatagtacg
10321 ggaaaaacta tgctacctgt gagccccgtc caaggacgtt aaaagaagtc aggccacttt
10381 gatgccatag cttgagcaac tgtgcagcct gtagctccac ctgagaaggt gtaaaaaatc
10441 cgggaggcca caaaccatgg aagctgtacg catggcgtag tggactagcg gttagaggag
10501 accccctccct tacagatcgc agcaacaatg ggggcccaag gtgagatgaa gctgtagtct
10561 cactggaagg actagaggtt agaggagacc cccccaaaac aaaaaacagc atattgacgc
10621 tgggaaagac cagagatcct gctgtctcct cagcatcatt ccaggcacag gacgccagaa
10681 aatggaatgg tgctgttgaa tcaacaggtt ct
```

FIG. 56 cont.

\>SEQ ID NO:382    P10 promoter sequence of AcMNP
GTCGAGTGATTGTAAATAAAATGTAATTTACAGTATAGTATTTTAATTAATATAC
AAATGATTTGATAATAATTCTTATTTAACTATAATATATTGTGTTGGGTTGAATTA
AAGGTCCGTAT \>SEQ ID NO:383    Polyhedrin promoter sequence of AcMNP
ATCATGGAGATAATTAAAATGATAACCATCTCGCAAATAAATAAGTATTTTACTG
TTTTCGTAACAGTTTTGTAATAAAAAAACCTATAAATATTCCGGATTATTCATACC
GTCCCACCATCGGGCGCG

FIG. 57

>SEQ ID NO:384      PaRV/WNV<sub>KUN</sub>-prME chimeric ISF protein

MSGLGGLLPLRGKKKKAPVIQSQGRVLPKSDWKGAPKQDLNKKKAKKDETKGQNWPRR
INPRTGQWSAIEGSGARLWRSIFSTDLIGGLLLLIAILSNLYEKVRRDITELKRRVTRLEKSR
ASLILTPMVLLCLAILAAGVTLSNFQGKVMMTVNATDVTDIITIPTAAGKNLCIVRAMDVG
HMCDDTITYECPVLSAGNDPEDIDCWCTKLAVYVRYGRCTKTRHSRRSRRSLTVQTHGES
TLSNKKGAWMDSTKATRYLVKTESWILRNPGYALVAAVIGWMLGSNTMQRVVFAVLLL
LVAPAYSFNCLGMSNRDFLEGVSGATWVDLVLEGDSCVTIMSKDKPTIDVKMMNMEAA
NLAEVRSYCYLATVSELSTKAACPTMGEAHNDKRADPSFVCKQGVVDRGWGNGCGLFG
KGSIDTCAKFACSTKATGRTILKENIKYEVAIFVHGPTTVESHGNYFTQTGAAQAGRFSITP
AAPSYTLKLGEYGEVTVDCEPRSGIDTSAYYVMTVGTKTFLVHREWFMDLNLPWSSAES
NVWRNRETLMEFEEPHATKQSVIALGSQEGALHQALAGAIPVEFSSNTVKLTSGHLKCRV
KMEKLQLKGTTYGVCSKAFRFLGTPADTGHGTVVLELQYTGTDGPCKIPISSVASLNDLTP
VGRLVTVNPFVSVSTANAKVLIELEPPFGDSYIVVGRGEQQINHHWHKSGSSIGKAFTATL
KGAQRLAALGDTAWDFGSVGGVFTSVGKAVHQVFGGAFRSLFGGMSWITQGLLGALLL
WMGINARDRSIALTFLAVGGVLLFLSVNVHADIGCGIDFDRKTYTCGSGLFVWKGLGKYP
TADHSVEFASYDFLSAYLQEQFKSEKKVCIICEDIVQCEAARKAAAAVYKNLGHPFVYVN
TSDSYGKVFAEIPKRVHTVSVGVDVVEMAMMTRENKPVGPFGDLPRSMVSWKSIPETEE
HPVLRVLTSSSDYQKVCGKAIGFQYDFVGYRRTMYGSNVQLKISKKVSIECPTYLAGVAV
KNDRTVFTDGMFWMSSKRENGTYAITELEMEQSHKCIWPDQYTPDATLTPRDNEMFVPP
EWGGPMSKANHIPGYKMQTGFPWNKAPIRFVEGSVPGTIVTQISHCDGRGIAAEVNPATQ
PNWCCKSCTRIFHFEVDGKLYYPMEIRPDPKGGEQQKVPVVETPIGDEETETVGGWLGRM
YNIPGAEGSYADFRLPKLPNSRPSAMVGSLVNLLCLMFSIQIVTKTMRARTLMRFYLCCLV
FMFFGMPTLFGLSGFLAWMMILPISHNSVTMCNLTVHLWAVLLNQSSAMFLWGLTLRSQI
QRSTAGQMLLFTMQMLHHAIYAHSWVFGWVIEVCLSVGLMMNLLTVIDTVHPKLIAYLL
FFGWKTGMCVVCAWLLIYSIRRWNSIVAAAPAAGGWRSGYRTMMSSSLIVIFISVGIAGVI
ASDYGGYPAAAAVTAALLIMGIKMFDFLTTRLSLEFVSAGMFPEGVEKAFEPDSVSDLFR
ASFTVDGIKLQDHVEPIPILFAILYIFIGAVACKVNPALGIVYAIAMFATPLPELMRLYMMTI
YSSTFRTDTLLGMAIPETEPELSQDFGPIPDGIYRVNNHGFSVKSHRGVGIVKNGVFHTLM
HVTLNEPLAWQNRLVGPSMGHSLKDYVTYGGNWQLPDFDIVNEVGIMVCGRDRSIQYKR
HEVGTIMIDDKRVMYFTHDYGHGSSGSPIFVNGEPVALYGFGFHLYNRYRSIVLPIPREEVL
DGASNEGIPAEHGTMRNKFFVDWHPGKGKTRKVIVKEVLNALNLARRIVVLAPTRVVLA
EITKAIGENTSKTPSKNLAFTGHNIVTVACHATFTDYVLRHGLSKFKAHEVIMDECHFLDP
RSIAARGILEHLATKRGVKVTFMSATIPGREPSLGSNFEISEQALQFPRDVNQRWIETVARG
KTVAFVPSHRVGDKLARGCPQAISLHRNNFDTNYSTAMDESIKFIYTTDISEMGANFSADT
VIDFRVAIKPKISSEFAVTLEPTPITRSSMIQRRGRVGRQRPGTYIYPVDKGVEDASDQLAC
WTEAQMLLDQLDLTMMAEEVRQSNIPGAYKLVGRSLDIFRKLLEKDDIPIWLSWKWADS
VQQQYSILFEGERQENVARVVNTRDYASLEYKPKFVDARFERLGWDQRKLSIQFYMNTRS
FITFATLSHVISQVIEAGVVNSAWKRIGDVSIIFTEGGDPHAKDETIMAWTILVGGVLGALG
FLIVAWGMKAVLRVIFGSRDKHLSVPTLVADFQPYIVCIVPIALHLAGVPIPMTIVFFAMLF
LTYPLMYKSAGQRSYVDIDLVKWILLGGCIVTGVICWEMRLLPNISSDISAILNRQRQREDT
PTFDASPPWEWLDLAQPVPHNVELTSVVITTFTTWLFLHQIVGWSYESEWLKSYFDHKGV
GQIMGGFRLDTISWGSALSGLLGTATYASWGAILTGLGGAVVYFFLMVSMLKWNFSGGA
TTGLENNVMRNDRETGLGNRPANDNRRSLLYGVVAAECLVWLFCFRTATDAIVVACLVS
YCLWIINNPASPHHKNTDLGSACSFIGLLYCTCPTQKCIQVLMRFALARLNMNTRSLEKSA
TGGLGHRWKKLLNAMTLLEFNAYRSCGVDETEKGDYVSRGGLKLREITMKYGWKPEGIC
VDLGCGRGGWSQHLAMDPRVTRVESFTLGGTARENPQPIKTLGHNLIRFKSGVNVYNMT
PTHANTIVCDIGESDPKPEVETSRTLRVLKTLELWLARNPNAEFVCKVLCPYPVEVLKCLE
TLQHKYGGRIIRSTYSRNSSAEMYYISGGRNNMVKVIFTTLHSLISRIRTRPEKIVKESVSLP
VGTRSDPGHKIKSMDPKMIATRVEKIKKEHADTWFVDNNHPYQSFRYVGSYVTDDVTPG
GQTVNPLMRKMMWPWETVGGVVNFMMTDVSTYAQQKVLREKVDTLSPEPPNDIQRVN
RWITEFLCASFMRRGLKPRILTMEQYINNVKSSAAIGSWSSDVPWSSVREALADKRFHQM
VEEERKLHLAGDCRMCVYNTMGKKEKKPSAMGVAKGSRTIWYMWLGSRFLEYEALGFL
NEDHWVSRDNLACGVGGVGVNYFGYYLQEIARKGKFFIADDIAGWDTRINESDLADEEF
LIMSLICDPYHRSLAKAVFRFAYQNIVALFPRNHPGFGSGTVMDVVARTDQRGSGQVVTY
ALNTITNAKIQLGRMLEAEGLLDAHEHVIKKWLNDNGEEALSGMVVAGDDVVVATNNG
NFSRSLRYLHLNGKIRKDIDPSLPSKVETNWEVVEFCSHHYHVMTLKDGRRIIVPCREQNEI
IGRGRIQKGGLVTLAESACLAKAYGQMWALYFFHRRDLRMAFLAITSSVPIDWFPEGRTS
WSIHQNKEWMTTEDMLRVWNTVWIQDNPWMEDKMEIENWRDIPYLPKSMDLKCGSLIG
TKERAAWSKDLPSTVTAVRKIIDQDTKTENVYQDFLGGMGRFQTYTDPMAT

FIG. 59

SEQ ID NO:385     PaRV/WNV$_{KUN}$-prME chimeric ISF vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata tggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag caccttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaccttt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 ttttaaaagt taacccgtgg ttttacccta gtttcggtga atttgccaat tttacggaat
1021 aactgtttga aaggttcaaa ctctggtgtc caacgtttgt attaaaatga gtggattagg
1081 aggccttctt cccctccgag ggaagaaaaa gaaagcccct gtgatacaat cacagggcag
1141 ggtcttgccg aagagcgact ggaagggagc tccgaaacag gatctaaata aaaagaaagc
1201 gaaaaaggac gagacgaaag gccagaattg ccaagaaga attaaccccc ggactggaca
1261 atggtcggca attgagggct ctggtgctcg gctgtggaga agcattttct ctacagactt
1321 gatcggaggc ttgttgttgt tgatcgctat tttatcaaat ctctacgaaa aggttagacg
1381 tgacataacg gaattgaaac gcagagtgac tcgattggaa aaatctcgag ctagtttgat
1441 tttgaccccca atggtgttgc tgtgtctggc tatcctcgcg gcaggcgtca ctctctccaa
1501 ctttcaaggg aaggtgatga tgacggtgaa cgctactgac gtcacagaca ttatcacgat
1561 accaacggcc gctggaaaga acctgtgcat tgtcagagct atggatgtgg ggcacatgtg
1621 tgatgatact atcacctatg aatgtccagt gttgtcggcc ggaaatgatc cagaagacat
1681 tgactgctgg tgcacgaagt tagcagtcta cgttaggtat ggaagatgca ccaagacacg
1741 acactcaaga cgcagcagaa ggtcactaac agtgcagacg catggagaga gcacccatc
1801 gaacaaaaag ggggcctgga tggacagcac caaggctaca aggtacttgg taaaaacaga
1861 atcatggatc ttgagaaacc ctggatatgc cttggtggca gctgtcattg gatggatgct
1921 cggaagcaac accatgcagc gtgtcgtgtt tgccgtgtta ctgctttttgg tagctccagc
1981 ttacagcttt aactgtcttg gaatgagcaa cagagatttc ctggagggag tgtccggagc
2041 aacatggtg gacttggtcc ttgaaggtga cagctgtgtg accattatgt ccaaggacaa
2101 gccccaccatc gatgtgaaga tgatgaacat ggaggccgct aacttagcag aagtccgcag
2161 ttattgctac ttagccactg tcagtgaact ctccaccaag gctgcgtgcc caaccatggg
2221 ggaagcccat aatgacaagc gggctgaccc atcttttgtg tgcaaacaag gagtagtgga
2281 tagaggttgg ggcaatgggt gcggactttt tggtaaagga agcatcgaca catgcgccaa
2341 atttgcctgt tcaaccaagg caacgggaag gactatctta aaggagaaca ttaagtatga
2401 ggtggctatc tttgtgcatg gaccaactac cgtggaatcg catgggaact acttcacgca
2461 aaccggagct gctcaggctg ggagatttag tatcaccccc gcggcaccct cttacactct
2521 taagctcgga gagtatgag aagtaacagt ggactgtgaa ccacgctcag ggatagacac
2581 cagtgcatac tatgtgatga ctgtcgggac aaagacttc ttggtccacc gtgagtggtt
2641 tatggacctc aacctcccct ggagcagtgc tgaaagtaat gtttggagga acagagagac
2701 gctaatggag tttgaagaac cacacgctac gaagcaatct gtgatagcat gggctctca
2761 agagggagcc ctgcatcaag ctctggcagg agccattcct gtggaattt caagcaacac
2821 tgtcaagctg acgtcaggcc acctgaagtg tagggtgaag atggaaaaat tgcagctgaa
2881 ggggacaact tatggcgtct gttcaaaggc cttcagattc cttgggactc ccgcagacac
2941 gggccatggt actgtggtac tggaactgca gtacacaggc acggatggac cctgcaagat
```

FIG. 60

```
3001 acccatttca tcagtagctt cattgaatga cctaacgcca gtgggcaggt tagttaccgt
3061 caaccccttt gtctccgtgt caacggccaa tgctaaagtc ctgattgagt tggaaccacc
3121 ctttggagat tcgtacatag tggtgggaag aggagagcaa cagatcaacc atcactggca
3181 caagtctgga agtagcattg gcaaagcttt cacagccacc ctcaagggag ctcagagact
3241 agcagctctg ggagacacag cttgggactt tggatcggtt ggaggagtgt ttacctccgt
3301 gggaaaggct gtccatcaag tatttggtgg agcattccgc tcattgtttg gaggcatgtc
3361 ttggataact cagggtctgc tggggcccct cctattgtgg atgggtatta acgctcgtga
3421 tagatccata gccctcacgt tcctcgcggt tggaggagtt ctgctctttc tctccgtgaa
3481 cgtgcatgct gacattggat gtggcattga ttttgacagg aagacctaca cgtgtggaag
3541 cggtctattc gtgtggaagg gtttgggaaa atacccaacg gccgaccatt ctgttgagtt
3601 tgcctcatat gattttctat cagcgtacct ccaggagcag tttaagtctg agaagaaggt
3661 ttgtattatt tgtgaagaca ttgtccagtg tgaggcagct agaaaagcag ccgctgcggt
3721 gtataaaaac ctaggccacc cgtttgtcta cgtgaacacg tcggactcct atggaaaagt
3781 atttgccgaa atcccgaaaa gagtccacac tgttagtgtg ggagtcgacg ttgtggaaat
3841 ggccatgatg actagggaga acaaaccggt tggaccgttt ggtgacttac cgcgtagtat
3901 ggtttcgtgg aagagtatcc ctgaaacaga agagcaccca gtgttgagag tgttgacatc
3961 ttcaagtgat taccagaagg tatgtggaaa agcgattgga ttccagtatg attttgttgg
4021 ataccgtcgg accatgtatg gatctaatgt ccagttaaaa atatcaaaga aggtttcgat
4081 tgaatgtccc acatacttgg caggagtcgc cgtgaaaaat gatagaacgg ttttcactga
4141 tggaatgttc tggatgtcat cgaaacgtga gaatggaaca tacgcgatca ctgagttaga
4201 gatggagcag tcccacaagt gcatctggcc agaccaatac actcctgacg ccactttgac
4261 gccacgtgac aatgaaatgt ttgttccgcc tgagtgggga gggccaatgt cgaaagccaa
4321 ccacattcct ggttacaaaa tgcagactgg atttccatgg aacaaagccc ccattcggtt
4381 tgttgaggga agtgttccag gaaccattgt cacacagatt agccactgtg atggtagagg
4441 gattgcagcc gaagtgaatc cagcaacgca gcccaattgg tgctgtaagt cctgtacaag
4501 gattttccac tttgaagtcg atgggaaact ctattatcca atggagattc ggcccgaccc
4561 gaaaggaggg gaacagcaaa aagttcctgt agtggagaca cccattggag atgaagaaac
4621 cgagactgtt ggtggatggc tgggtagaat gtataacatt ccaggagctg agggatcata
4681 tgcggatttt cgactcccca agttgccaaa ttcaagacca agcgcaatgg tggggagttt
4741 ggtcaatcta ttatgcttga tgttttcaat tcagatagtt accaagacta tgcgggcaag
4801 aacgcttatg cgtttctatc tttgttgctt ggttttatg ttctttggaa tgccaacttt
4861 gtttggatta agtgggtttt tggcgtggat gatgattcta ccaatctcac acaactcggt
4921 aacaatgtgc aacctaaccg tgcatctgtg ggctgtactg ctaaaccaga gctcggcgat
4981 gtttctgtgg ggcctaacgc tccgatccca gatacagagg tctaccgctg gacagatgct
5041 actctttacc atgcagatgt tgcatcacgc catctacgcg cactcttggg tgttcgggtg
5101 ggtcatcgaa gtatgcttgt cagtcgggct tatgatgaac ttgttaaccg tcatcgatac
5161 ggttcacccg aaactgatcg catacttgct cttcttcgga tggaaaacgg gcatgtgcgt
5221 agtgtgcgct tggttattga tatactcaat caggagatgg aactctatag tcgccgcggc
5281 tccggccgcg ggcgggtgga ggtcagggta tcgaacaatg atgtcctcca gtttgattgt
5341 tatctttatc agtgtaggaa ttgcaggagt tatcgcttcg gactatggag gttatccggc
5401 tgcggctgcg gtgactgcag cattgttgat aatgggaatc aaaatgtttg acttctgac
5461 gacccgattg tctcttgagt tcgtatctgc aggcatgttc cccgaaggtg ttgaaaaagc
5521 ctttgaaccg gactcggtca gtgacttgtt tagggcatct ttcactgtag atgggataaa
5581 gttgcaggac catgttgaac cgatccccat tttgtttgcc attttgtaca tctttattgg
5641 agctgtggcc tgtaaggtta acccggcccct cggaatagtg tatgctatcg ccatgttcgc
5701 gactccttta ccggagttaa tgcgtttata catgatgacc atctattcct ctacatttcg
5761 gacagacact ctgcttggga tggctatccc agaaacggag ccagaactgt ctcaagactt
5821 tgggccaatc cctgatggga tttatcgggt gaacaatcat ggattttcag tgaagagtca
5881 tcggggagtt ggaatcgtaa agaatggggt ttttcacact ctcatgcatg tcacgctcaa
5941 tgagccactc gcgtggcaaa atcgcctagt aggaccttca atgggccact ctctcaagga
6001 ctatgtcaca tacggtggaa actggcaatt gcctgacttt gatattgtta atgaggtggg
```

FIG. 60 cont.

6061 cataatggtt tgtggacggg atcgttccat tcagtacaaa agacacgagg ttgggacaat
6121 catgatcgac gacaagcgag tgatgtactt cactcatgat tacgggcacg gatcatctgg
6181 ttcaccaatt tttgtgaacg gagaacctgt ggccttatac ggcttcgggt tccatttgta
6241 caataggtat cgatcaatag ttctgcctat cccacgtgaa gaagtccttg atggggctag
6301 taatgagggc ataccagctg agcacggaac catgcgcaac aagttttttg ttgactggca
6361 tccaggaaaa gggaaaaccc gaaaagtgat cgttaaagag gtgttaaatg ctttgaattt
6421 agcacggcgg attgttgttc tggcccctac acgagttgtc ctggctgaaa taactaaggc
6481 aataggggaa aacacatcaa aaacgccctc aaaaaatctt gctttcaccg gtcacaatat
6541 tgtgacggtg gcttgccacg cgacgttcac tgattatgtt ttgcgtcatg ggttatcaaa
6601 attcaaagct cacgaagtca taatggatga gtgccatttt ctggacccac gatctatagc
6661 tgcgagagga atcctggagc atctggcaac taaacgtgga gttaaagtca cgtttatgag
6721 tgcaacgatc ccaggacgtg aaccttcact cgggtcgaat tttgagatct ctgaacaggc
6781 cttgcagttt ccccgtgacg tcaaccaaag gtggatagaa actgttgcta ggggaaagac
6841 cgttgccttc gtgccatctc acagggtagg tgacaagcta gctcgcgggt gtccccaagc
6901 catttccctg cataggaaca attttgacac caattacagc acagctatgg atgagtccat
6961 aaaatttatc tacaccactg acatatcgga aatgggagcc aatttcagtg ctgacaccgt
7021 catagatttc cgggtggcga ttaagccaaa gatttctagt gaatttgccg tcactcttga
7081 accaactccg atcacgcgat catcgatgat tcaacggcgt ggtcgagttg gaagacaacg
7141 acctggaacc tatatttacc cagttgacaa aggcgtcgaa gatgcctccg atcagttggc
7201 ttgttggaca gaagctcaga tgttgttgga tcaattggac ttgacaatga tggcagagga
7261 agttcggcag tcaaacattc cagggggctta caaattagtt gggcgtagcc tagacatatt
7321 tcggaagttg ctggagaagg atgacatacc aatctggctg agctggaagt gggccgacag
7381 tgttcaacaa caatactcca tattgtttga aggagaacgt caagagaatg tcgctcgtgt
7441 cgtcaacact cgagactatg cttctctaga gtataagccg aagtttgttg atgcacgatt
7501 cgagcgtctt ggatgggatc aacgaaagct gtcaattcag ttttacatga acactcggag
7561 cttcataact ttcgccactt tgtcacacgt catttctcaa gtgatcgaag ctggagttgt
7621 caattctgct tggaagcgaa taggagacgt tagcatcatc tttactgaag gaggcgaccc
7681 acatgctaaa gatgaaacta tcatggcttg gactattctg gttggaggag tgttgggggc
7741 tcttggattc ctcatagttg catggggaat gaaggctgtc ttgcgagtaa ttttcggatc
7801 ccgcgataag catcttagcg tcccaacctt agtggcggat ttccaaccat acatagtgtg
7861 tatagttccc attgccctac atcttgctgg ggttcctata ccaatgacaa ttgtgttttt
7921 cgcgatgctt ttcttgactt atccactaat gtacaagagt gccggacaac ggagttatgt
7981 tgacattgac ttggtgaaat ggattctgtt aggtggatgt attgtaactg gagtcatttg
8041 ctgggaaatg agattgctcc caaacatctc atcagacatt tcagctattt gaataggca
8101 aagacaaagg gaagacaccc caacttttga tgcttcacca ccttgggaat ggttggattt
8161 agcacagcca gtccctcaca atgttgaatt gacgtcagtg gtgataacta cattcacgac
8221 ctggctgttc ttgcaccaaa ttgtcggatg gtcatacgag tcagagtggc tgaaatccta
8281 tttcgaccac aaaggagtgg gtcagatcat gggtggtttt cggttggaca caatttcatg
8341 gggatcagct ctaagcggtc ttctgggcac agctacttat gcctcatggg gagccatttt
8401 gactgggtta ggaggagcgg ttgtgtattt tttcctgatg gttcaatgc tcaagtggaa
8461 cttttcggga ggagccacaa ctggcttaga aaacaatgtc atgcgaaacg accgagaaac
8521 tggactaggt aatcggccgg caaacgacaa taggcgttcc ctcctgtacg gtgtggtggc
8581 ggctgaatgt cttgtgtggt tgttctgttt cagaactgcc acggatgcca tagtggtggc
8641 ttgttttagtg tcctattgtt tatggatcat caacaacccg gctagccctc accacaaaaa
8701 cactgactta ggatcggcgt gtagtttcat cggtctttg tactgtacat gtcctactca
8761 aaaatgcatc caagtattga tgaggtttgc tttggccagg ttgaacatga acacccgctc
8821 tctggaaaaa agcgcgacgg gaggccttgg acaccgttgg aagaagctat taaatgcgat
8881 gacactattg gaattcaacg cttaccgatc ttgtgagtt gacgagactg agaagggtga
8941 ctatgtgtca cgaggagggc tgaagctgag agagataacc atgaagtatg gttggaagcc
9001 agaagggata tgtgttgatc ttggatgcgg cagaggagga tggtcacagc acttggctat
9061 ggatccccgc gtaactagag tggaatcatt cacgttagga ggaacagcac gagaaaatcc

FIG. 60 cont.

9121 ccagccaatc aagacacttg gtcataacct tatccggttc aagagtggag tcaatgtgta
9181 taatatgacg ccaacacatg ctaacaccat agtgtgtgat atcggagaaa gtgaccccaa
9241 accagaggtg gaaacctcta gaacattgcg ggtcctcaaa acacttgaac tatggttggc
9301 caggaatcca aacgctgaat ttgtgtgcaa agtcctttgc ccatacccg tggaagtcct
9361 caaatgtctg gaaaccctc aacataagta tggcggaaga attattaggt cgacgtatag
9421 ccgaaattca agtgctgaaa tgtattacat ttctggaggc cgtaacaaca tggtgaaggt
9481 tatcttcacc accctccact ccttgatttc gaggatacga actaggccgg agaaaatcgt
9541 caaagaaagt gtttctctac cagttgggac tagaagcgat ccagggcaca agatcaagag
9601 tatggatcca aagatgatag caacgcgggt ggaaaagata aaaaaggaac atgcggacac
9661 gtggttcgtt gacaacaacc atccatacca atcatttcgg tatgtgggat cgtacgtcac
9721 agatgatgtg acaccaggag gtcagactgt caacccatta atgagaaaaa tgatgtggcc
9781 gtgggagact gttggaggag ttgtaaattt catgatgacg gacgtgtcca catatgccca
9841 acagaaggtg ttgcgagaga aggtcgacac actatcccct gaacctccaa acgacattca
9901 aagggttaac agatggatca ccgagttctt gtgtgcttca ttcatgcgtc gagggttgaa
9961 acctagaatc ctgaccatgg agcaatatat caacaacgta aagagctcag ctgccattgg
10021 atcgtggagc agtgatgtcc cgtggagcag tgtccgagaa gcttagctg ataaaagatt
10081 ccaccaaatg gtcgaggagg aaaggaaact ccacttagca ggagactgcc gcatgtgcgt
10141 gtacaacacc atgggcaaga aggagaagaa accttcagcc atgggcgtgg ccaagggctc
10201 tcgaaccatt tggtacatgt ggttaggttc acggttttg gagtacgaag cccttggctt
10261 cttaaatgaa gatcattggg tgtcacgaga caacttggca tgtggtgttg gtggagtggg
10321 agtgaattac ttcggctact acctacaaga aattgcacgg aaagggaagt tttttatcgc
10381 cgatgacata gcgggatggg acacgcggat caatgagagt gacttggccg atgaggaatt
10441 tctcatcatg tccctcattt gtgacccata ccatcgatca cttgcaaaag ccgtgtttcg
10501 gtttgcctac cagaacattg tggccttgtt tccgcgaaat catcctgggt ttggaagtgg
10561 aacggtgatg gatgtcgtgg ccagaactga ccaacgaggt tcaggacagg tcgtgactta
10621 cgctctaaac acgataacga acgccaagat tcaattaggc agaatgctgg aagccgaagg
10681 attactagac gctcatgaac atgtaatcaa aaaatggtta aacgacaatg gtgaagaggc
10741 tctctccggg atggtggtgg ccggggatga tgttgtagtt gcgaccaaca acggaaattt
10801 ttcaaggtcc ttacgatacc tccatttgaa cggaaaatt cgtaaagaca ttgatccgtc
10861 cctaccgtcc aaagttgaaa cgaactggga ggtggttgaa ttttgttctc accattacca
10921 cgtgatgacc ttaaaggacg gacgacgaat aattgtccca tgccgagagc agaatgaaat
10981 cattggacga ggcaggattc aaaaaggagg gttggtgacc cttgccgaaa gtgcctgcct
11041 agcgaaggct tatgggcaaa tgtgggcttt gtatttcttt caccgaagag atctgcggat
11101 ggcttttcta gccataactt cgagtgttcc aatagactgg ttcccagagg gccggacctc
11161 gtggtcgatt caccaaaata aagagtggat gaccactgag gacatgttgc gggtctggaa
11221 tacagtgtgg atccaggaca atccctggat ggaggacaaa atggaaatcg aaaattggag
11281 ggacattccg tacctcccga aatccatgga cctaaagtgc ggcagtctca ttggaacaaa
11341 agaaagagcc gcttggtcaa aggatctgcc gtcaacggtc acggcagttc ggaaaattat
11401 cgaccaagac acgaaaccg agaatgtcta ccaagacttt cttggcggaa tgggccggtt
11461 ccaaacgtac actgacccca tgcaacgta agaaaccatc ttttccaaat tagtcgaaaa
11521 attttgcccc tcttcgaggg gctttggcgg cagcaggaga ttttctccgg ggtttcacgc
11581 tcccccgat gccagtggtc acagcccaag tcagagactt ggagttgtgg cgggacagtg
11641 agctctgtca gtggtcaata gctcaataaa tatggcagca gagcttgtct cggggattca
11701 cgctcccccc attgtgagtg tgtcgaactg gtttcgaagg acgtctagaa cgacgctaaa
11761 gttcaaatcc ggcaacagag agtttatgtc tcggggcctc acgcaccccc cgttgtgagt
11821 gaagtccttt ctggccattt agtggtcagg aagggtaccg ttttggaacg acggaaataa
11881 gttccatgga gcgacactag ccccactgag gggcggttgg aatgacaccc aacccgctat
11941 agtgcgtcga caggtcaatt agctacctgg aataagctaa tgtgcagggc aacaaagttc
12001 taacgaacta gggtgagtag cgtcaccccc cggttgtgaa aacgattgcg actagaacta
12061 aagtcgagag tctccccacc gataggggag ctcgtcagtt tgttttagtc caattacgct

FIG. 60 cont.

>SEQ ID NO:386 LiCV genomic nucleotide sequence

TACGTAGAAGTATAACACGTTGAAGTAAAGTTTTGAATCAAGAGATAAATCATGG
TTACAAAACTCAGGAGGCCCGCAAGGCGGGCTGTCGATATGATTAGGCGTGCGG
TACCCCGCGCCGCAGGACCACGTAAGGTCCTAACTAGGGTATCAAACACCATGA
AGCGCAATGCTGGGGCATTGAGAGCTCTCTTGGCCTATCTTCTTTTCCAGACATTT
GCTGGAAGAAAGGTAGGCACTAGAGCCCGCACCGCACTCAAGCGCTTCAATAAA
AATGACATCGTGAAAATGCTGCTGGCTTTCCGAAGAACATTGACGAACATAATCA
CCACCATGCAACGCCGCGTGAAAGGGAAAAACCGAAGGGGATTGCAGGAAGTGT
CATTGGTCGTTACAGCGCTAATGGTTGTAGGAGTCTTCTCTGCCACGCTAAAGAC
TGTGGGAGAATATTCATGGCTCAACGTTACAAGCAATGATGTAGGAAAATGGATC
CGAGTGGAAAACAGAAATGGACGTGGAGAGTGCTTTGTGACAGCCACTGATGTT
GGAACATGGTGTCCAGACTCAGTTGGCTACGAGTGCCCTCAGGTAGCTCCTGCTT
ATGATCCGGAAGACTTAGACTGTTACTGTCGGAATACATCCACTTACGTCACGTA
TGGGAGATGTAAGAATGGAAAAAATGGCCGATCACGTAGCAAACGCTCTGTGAC
CATAACGCCACATGGAGAAGCTGGCCTGCGCGTTGGAAGCACTAAACACTGGAC
ATCCCGAGCTTCGCCTGAACGCTACCTAATGAGAGTCGAAAAGTGGGTGCTGAGG
CATCCCCTACCGGCGTTTGTGCTGGTGATCCTAGGATGGATGATGGGAAGAACTC
ATGGGCAACGGATCATGTACATACTGCTAATGCTTCTCGTGGCCCCATCCTATGG
CAACCAATGCTTGGACGTGCAATCTCGGGACTTTGTCCAGGGTGTCAGTGGAGGG
ACATGGGTTGACGTGGTTCTAGACCATGATAATTGCATCACTATTGTTGCGGATG
GCAAGCCATCATTTGACATCCGGCTGACCAAAATGACGATGACAAAGTTTGCTGA
TTACAAACGATACTGCCTTCAGGCGACGATGACAGATGTCACCAGCATAGTGGCA
TGCCCAGGAGCAGGAGACGCCCACAATGACAAAAGTAAAAACCATGACTACATC
TGCAAGGCCGTCACCAATGACCGTGGATGGGGAAATGGATGTGTGTTATTCGGAA
AAGGATCAATGGAAACGTGTGGGAAATTCGAATGTAAGAAGAAAATGGCCGGTA
AGTTGGTGGCTCGTGAGAACGTGGAATCCGTGGTCACAGTACACGTGCACGGAG
CGTCAGCAACTGACACCAAGGGAGTGGACACTGCTTCGACAGCCACGGCGACAA
TAACGCCTAAATCCTCAACTGCCAGTGTGAACCTTAATGACTTTGGCAGTGTTGA
GGTGGACTGTTCAACAGATGTCGGAATGGACTTTGGTGAAGTGGTGGTAGCTGAC
ATGGCTGGAAAGTGGTGGATCGTGAACAAAGACTGGTTCAATGAACTGGCTTTGC
CATGGTCGACGGCCAGCGTAGCAGCAGAAGTCTGGCAAGGACGCGATCGGTTAA
TAGAGTTCGGATGGCCACATGCAGTAAAGCAAAACATATATGACATCGGAGACC
AAGAAGGAGCTGTAACCGCAGCCATAGCGCAAGCGCCCATGGCAAAATGGGAGT
CTGACAAAGTTGAGCTTGCTTCTGGAATCTTGAAATGCAAAGTTAAACTGGGAAA
CCTCAAGCTCAGAGGAATCACATATGGTATGTGTACTAAGAGTTTCAACATGGAA
ACTCGTCCAGCTGACACTGGGCATGGTACCGTAGCCTTCAAATTGAAATACACTG
GAAGTGATGTTCCATGTCGTGTGCCACTGAATGTGATTGACAGTGACGGAGGAGT
AGCGGCTGGAAGAATTATCACAGCCCACCCTTTCGTTATGAAGCAAAACGATTAC
ATTATCATAGAAGTGGAACCACCATTCGGTGACAGCAAGATAGAAATTGGAACT
GGAACGACCAAGTTGACCGAAGCATGGCATCGAAAAGGGAGTTCTATTGGCAAT
GCTTTTTCAGCTACGTATAAAGGCATCACCAAGTTGACTGTGCTCGGGGAGCATG
CTTGGGATTTCAACTCCTTGGGAGGCTTCGGAGCCAGCCTGGGAAAAGCGGTGCA
TACCCTCTTCGGAGGAGTGTTTAGGGTGCTCTTTGGAGGCATGGGATGGCTGACG
AAGATCCTGGTCGGAGCCATTCTAGTGTGGCTGGGGCTGGGCGCCCATGACAAGA
CCATAGCCACTACGATGATAGTTGTGGGCTCCATGTTGATGTATTTGGCAGTGTC
AGTGGGGGCTCTGTCAGAGATTGGGTGCAGTCTGGACATCGCTAGAAGAGAAAT
GAAATGTGGCGATGGAGTTTTCATTTTTAGGGAAGCTGGGATGTGGAAAGAAGGT
TACGCGTTCCATCCTGCAGAACCTAAGACGTTGGCTGCCTCAGTCCTCAAGAGTT
GGAAAGCTGGGGTTTGTGGAGTACGCTCCACAAGCCGCATGGAGCACGCGATGT
GGAAACAGATTGAGAATGAGCTGAATGGCATACTTGAAGAAAATGAAGCTCATT
TGAGTGTAGTGGTCAAGGAAACCAACGGCACCTTCCCCCGTGGAGATCGCAGAA

FIG. 62

```
TGCAAGTGGCGGAGCCTCTGAAGTATGGGTGGAAGACCTGGGGGAAGACCGCTG
TGTCTACTGTTCCCCTGGCCAAGGAAACTTTCATCGTTGATGGCAGTGATGAAGG
AGAATGCCCTTCCCAACTCCGAGCGTGGAACTCATTCCAAGTTGAAGAATTTGGA
ACAGGCCTCCTCAAAACTAAAGTCTTCCTTGATATCTCAACAGCCGTGACTGTCC
AGTGTGACACCAAACTGCTTGGAGCGGCCATCAAGGGAAACAAATCTGTACATG
GAGATCCTGGTTTGTGGATGGTGTCTGCTGAGATAGATGGTGTCTGGCAGATAAC
TGAATTGACCCTAGCTGAAAGTCGAAGATGTATGTGGCCAGACTCGCACACTGTA
TGGGGCCGGAATGTTTTGGAGAGCGAACTCATTCTTCCTCCTACGTACGGGGGAC
CAGTGACAAACATGAACAAGCGTAGAGGATACGCCACCCAAGTCAGTGGACCTT
GGAATCATGTGCCCCTGAAGGTGGTCTTCGAGGAATGTCCTGGAACCACCGTGAC
GATTGAACCTAACTGCACCAAGCGATCAGAATCAGTCCGGTCCACTACGGATAGT
GGAAAGATAATATCTGACTGGTGCTGTCGTTCGTGCACTATGCCGCCCTGACAT
ACCGCACCCCTGACGGATGTTGGTATGCTATGGAGGTTCGACCGAAGAATGTCAA
AGAGGAGAGCTTAATTCGATCACATGTGGCAGCAGGAGTATTCAAAGGAATAGA
TGATGTCTCACTGGGATTGCTCGTCATGATAATATTCCTGCAGGAAGGCTTGCGA
AGAAAGTTGACGACCACATATATAATGTGGGCTGCCTTGGTAGTGTTGACAGCAG
GAATTTTGGGAGAGCTCTCTCTAAGAGACGTGCTGCGGTACCTCATTCTGGTAGG
CACAGCTTTCTCTGAGGCCAATAATGGTGGAGACCTAATACATCTGGCTCTCGTG
GCCGTTTTCAAAATCAGACCGGCTTTCTTGTTTGGATTCTTATTCCGTGCGAAGTG
GTCACCCAGAGAGGGAGTGCTTTTAGCTTCAGGAGCATTAATGCTGCAAATAGCC
AGTGAATGCCTGTACGCAACAGCCATCATGCAAGTCGTGGATGCATTGAGCATGG
GGTGGCTCATGATCCGTGCCATTGCTATCCCAGGAATGACGTCAAAGGCCATGCC
TCTGTTATGTGCATGTATCCCTGCTGTCACATCCCTGCTAGTGCATTCCACACGAG
TTGGAGTTATCACCTTGGCTGGCATGTCTTTGATTGCGGGCAACAAAGGCTCATCT
GTCAAAAAACATGGTCCGTATTTGGTAGCACTAATAACCACTGCGATGGGAGCAA
GTCCGGTTGGAATGCTGGCCATGGAGGCGTTTTCCCACTTAAAGTCTAGGAGATC
TTGGCCAGCTGGTGAAATGATGTCAGCTGTGGGACTGACATGCGCACTTGTTGGA
GCCATAAGTGGTACGTCATCACATGACTTTGCTGGGCCCCTGGCTGCAGCAGCCC
TCATCATCATAGCATATGCGATAAGTGGAAGGTCAGCTGATGTATACCTAGAAAA
AGCTGGAGAGATCTCTTGGAGTGAGGATGCCAAGATATCTGGATCAAGTCCACGC
ATAGATGTATGCGTGACCGAGAACGGGGATTTCAAACTGCGGCATGAAGGGGAA
GCAACTTGGACTCGCAACTGCATTCTAGCTGCCTGCTTAATAGTGGCTGGAGTGC
ATCCGTTGGGCATTCCAGTGGCTGGATTGATGTGGTTCGGATATGTAAAAGCTAA
CAGGAGAGGCACGGTGCTGTGGGACATTCCGTCACCACAGACAAATGCAGCTCC
AACTGTAGAAGATGGATGTTACCGTGTAATGTCGAAGAGACTCCTGGGGAGCAC
CCAGCTTGGAGTAGGGATCATGTTGGATTCAACATTCCACACCATGTGGCACATC
ACTCGAGGGGCTTCCATAGTCAGTGGAGAAGGACGCCTAGATCCGTACTGGGCTG
ATGTAAAAGAAGACCTGGTGTGCTATGGAGGACCATGGAAGATCCGTAACATGT
GGGACGGCATGTCTGAAGTTCAATTGATCGCGGTGCCACCGAAGGAAAACCCTGT
CAATGTGCAAACCATGCCCGGCAAATTCGTGGTTGCCAATGGAGGTGAGATAGG
AGCTGTTGTTCTTGACTACCCTCCTGGAACTTCTGGATCCCCTATAGTTGATCAAC
AAGGGAACGTCATTGGACTGTATGGAAATGGAGTCATGATCAATGATCAGACGT
ATGCCAGCGCGATAGCACAAGCTCCGGTTGAGGCAGCGCGAACCCCCACCTGGTT
TAGTGAGGACATGTTACGCAAAGGCCAAATCCATGTTCTGGACTTACACCCTGGA
GCAGGAAAAACACGCAAAGTGCTCCCTGAAATTCTAAAGGCAGCTGTGGAAAAA
CGGTTA
```

FIG. 62 cont

```
AAAACCCTGGTCCTGGCCCCTACGCGGGTGGTGGCCAAGGAAATGCATGAGGCT
CTAACGGGACTCCCTGTTAGATACCAGACATCGGCCATACCACCAACATCGTCTG
GGGGTGAACTGATAGATGTAATGTGTCATGCCACATACACACAGACAACTAA
CCCCTGGGAGAGGCATTAACTATCAGCTCTATATCGTGGATGAGGCACATTTCAC
GGATCCGGCATCAATAGCAGCTAGAGGAATAATAGCAACTAGAGTGCGCCTGGG
GCATGCCGCTGCAATTTTATGACAGCAACACCCCTGGAATGTCCAACCCCTTTC
CGGAGTCTAATGCACACATAGAGGACGAGGAACGGGAGGTGCCCACAAAGGCTT
GGAACTCCGGATATGAATGGATCACAGACTACAGTGGGCGAACGGTGTGGTTCG
TGCCATCAATACGCATGGCTAACACCATTGCCTCATGTTTAGTGCGAGCCGGCAA
GGTGGTGATCGTCCTCCATAGTGGATCATTTAATGAGGAGTATCAGAAAACAAAG
TCTGGCAACTGGGACTTTGTGGTCACTACTGACATATCAGAGATGGGAGCCAATT
TCAAAGCCTCTCGAGTCATTGACTCTCGGCTTTCTATAAAACCCATGTTCTCTTAT
GCCCCTAGTGAGCGCGTTGTTATAGGTATGCCCAGGCCAGTGTCTCCAGCTAGTG
CAGCTCAGCGCCGCGGACGGGTCGGGAGGGACCCTAGACAACTTGGAGACCAGT
ACATATATGGAGGTCCCATCGGAGAGGACTCAGCAGAATACGTCCATTGGACTG
AGGCGAGGATCCTGATGGACAATGTCACCGTTCCAGGTGGTCTGTACCCACAGTT
CTATGAACCTGAAAGTGGAATGTGCAACGCCATGGATGGGGCCCACCGATTGAC
AGACACCAAACGAGAGGTGTTTCGAGACCTTATGAAAAAGGAGAGCTACCGGT
ATGGCTTGCGTACCAGGTGGCTCAAGCTGGACACGCGTACACAGACAGAACATG
GTGCTATAGTGGACCAGCTGACCATCAGGTGTACGACGACTGTGGGCAAACTGTG
GATTACAGATCACTGAATGGGGAGCGACGCATGCTCAGACCAAAATGGCTAGAC
CAGCGGACGTACAATGATAAGACCTCTTTGAGGCTTTTTACTGAGTTCGCGGAGG
GTCGTAGACGGTATTCAGAGCTTATTGATGTGTTCGGCCGCATGCCTCAACACAT
GCTGGACAAAACTATATTAGCCGCAGATACATTCAAGGATGTGCTCACAGCCACT
CCTGGATCCCGTGTTCATCGCTTGGCGCTGGACAACTTGCCTGAAGCCACGGAAA
CGATAATGGTACTGGGAATATTGAGTGTGTCGACGCTGGGAGTTATCTTGTTCCT
CATGTCCCCAAAAGGAATGACTCGCATGACATGTGGGTTGGTGGTTATTATACTG
GCCACTTATTTCTTGTGGGTATCAGGGATGGCAGGTTATCAAATAGCGGCTGTTC
AGCTCATGGCCTTTGTGCTGTTTGTGGTACTGGTTCCAGAACCAGGATCACAACG
GTCGGTACAGGACAACACGATTGCTATCATCTTGATAGTCATCTTGTCTTTGGCAG
CCGCAATAGCGGCTAATGAAGCTGGACTATTAGAAAAGACCAAGAAAGATTTCA
CGTGGAGAAAGGAGAAACCGACACAACTGGAGACAAGTCCCTGGAACATAGACT
TTTCCATGGACCTCCGGCCAGCTACTAGTTGGTCACTGTACGTAGTGATGGCAAC
CATGCTGGGACCAGTGCTCGAGCATGCGATTGTGACTAACTATGCGAGTGTTTCT
CTCACAGCAATTACCAATCAGGCCGGAATCCTCCTGTCCATGGATAAGGGAACTC
CGTTTTGGAATCTGGACTGGAGTGTCGTGTTGTTGTGTGTTGGCAGCTGGTCAGG
AATAAATGGAACTACCCTCATGGTGGCATCGGTCATGACTGTGCTACATTTTGCG
ATGATTCTTCCGGGAATTCGCGCAAAAGCAGCTAGAGAAGCTCAGAATAGAACA
GCCGCTGGAGTGTCTAAGAACCCCTGGTGGACGGGATGAACACCATCAACATCC
AGCCGCTACCGGAGCTAGACCCCATGTACGAGAGGAAAATGGGTCTGTGGATGC
TCATTGCAGTTGCTGGAGCAGCGGTAGTCTTCGACAAGAGGATGCTGCACTATAC
TGAATTCGGAGTACTAGGTTCTGCAGCCATTACCCCTCTAGTTGAGGGGTATGCA
TCTGCAGTCTGGAACACCTCCGTGGCTGCTAGTGTGTGCAACTTAATGAGGGGAC
ATTACATGGCCGGAGTTCCAATGGCATATTCTTTGATCAGGAATTTGTCAATGAA
AGGAGTGTCTAGAAGAGGAATTCAGGCTACACGCACACTTGGCATGGTTTGGAA
ACACAAGCTCAACACCATGGACAAAGCCATGTTCAATGCATACAAAAAGGACGG
AATCACTGAAGTTGACAGGGAGCCAGCTCGAGCGGCTATGAAAAAGGAGATCT
AGTAAGTGGGTGGGCTGTCTCGAGAGGATCAGCAAAACTCAGATGGATGCACGA
ACGGGGATTCATCCCACTGCAAGGAACAGTGGTTGACCTCGGGTGCGGAAGAGG
CGGATGGAGCTACTACGCAGCCGCACAGCGAAAAGTGACGTCTGTCAAGGGGCT
AACCAAGGGAGGCCCTGGACACGAGGAACCCGTTAACGTCCAGTCTTATGGGTG
```

FIG. 62 cont

GAATCTAATCTCGTTTCGGAGTGGAGTAGATGTCTTCCACACTGATGTGCAACCA
GCAGACACACTGCTGTGCGACATAGGTGAATCGTCATCTGATCCCAATTTAGAAA
AGACACGCACACTTCAAGTTCTGGTTAATTTTGAGAGGTGGCTTAAGGAGTCAAA
ATGCGAAAATTTCTGTTGCAAAGTTCTCGGACCTTACTTACCAGAGGTCATGGAA
CGGCTTGACCGACTCACAAAAACTTATGGTGGAGCCGTCATCCGAAATCCTCTCT
CCAGGAATTCGACACATGAGATGTATTGGGTCTCGGGCGCTAAGGGCAATCCTGT
CAATGCGATCACAACTACTTCCCGAGTGCTGCTGGAGCGCATGTGTAGGCGGGTA
GGGAAAAGTTACTGGGAAGAGGACGTCAATCTTGGAACTGGAACCCGAGCAGTA
ACCTGCTCAGCTGAAACACCAGACATGTCGAAGATAGGAAGACGCATTGAGTTG
CTCAAGAAGGAGTACAGGGCGTCCTGGTTTGAGGATCCTGAACACCCTACAAG
ACTTGGACATACCATGGGTCATATGAAACCAAGACCACTGGGAGCTCGTCTAGTA
TGATCAATGGAGTGGTGAAGGAGATGACTCACCCATGGGACACAAATCCAAGAG
TGACTACAGTGTGTATGACTGACACCACACCTTTTGGACAGCAACGTGTGTTTAA
AGAGAAAGTAGACACCAAGGCGCGTGAACCATCCGATGGCACTAGAGAAGTCAT
GAGGATTGTCAGCAAATGGCTCACGATGTACATTGGCCGGACCAAAAAGCCCCG
CATTTGCACAGCGGAAGAGTTCATCGCGAAGGTAAACTCCGATGCTGCACTTGGG
ACGATGTTTGACTCCCAAGGAACGTGGGCGAACGCCAGAGAGGCAGTTCAAGAC
CCAAGGTTCTGGCAGATGGTGGCACGTGAGAGGGAACTCCACTTGCGTGGACAA
TGCGCCACCTGTGTCTACAACATGATGGGAAAAGAGAAAGAAAATGACAGAG
TTTGGCAAATCAAAAGGTAGCCGAGCCATCTGGTTCATGTGGCTAGGAGCCCGCT
TTTTGGAATTTGAGAGTCTGGGTTTCCTAAATGAAGACCATTGGTTGTCGCGAGA
AAACTCAGGAGGTGGTGTTGAGGGGATAGGTCTGCAATACCTGGGTTATGTTCTG
CGGGACATGGCTGCAATTCCGGGGGGCGGATGTACGCTGATGACACCGCTGGC
TGGGATACACGCATCACCAATGCTGACTTGGAAGACGAAATGGACATATTGGATC
TAATGGATCCCCACCACAAAAAGTTAGCTAGGAACCTCATGGACTTGGCTTACAA
CAATAAGGTTGTGAGAGTCATGCGCCCTGGTAAAGGAGGCAAGACTCTGATGGA
CATCATCAGTCGCAAGGATCAACGCGGGAGTGGTCAGGTTGTGACATACCCTTTG
AACACCTGGACCAACTTGAAGGTGCAGCTCATCCGCATGGCAGAGGCTGAAGGG
GTGCTTGACCCGCGTGAAGTAGAGGGCATCACACACACAACGAAAAACAGTCTC
GAGAAGTGGCTCACAAACCACGGAGCTGAGCGGCTGAAACGCGTTGCAGCCAGT
GGAGACGATGTCGTTGTTAAACCCATTGACGAGCGGTTTGCGTCCGCTCTCACAT
ACCTTAATGACATGGCGAAAACTAGAAAGGACATCTGCGAATGGAAACCATCAA
CTGGCTGGTACCACTGGGAGGAAGTGCCTTTCTGCTCTCACCACTTCCACCAGCTC
ATGTTGAAAGATGGTAGAACTCTTGTTGTGCCGTGTCGGGACCAGGATGAGCTGA
TTGGTAGAGCACGTGTGTCCCCTGGAGCTGGATGGACCATTAAGGAAACAGCTGG
TCTTAGCAAGGCTTACGCGCAAATGTGGCTGTTAATGCACTTCCACCGGAGGGAT
CTTAGAATGGCTGGGTTTGCAATATGCAGTGCGGTGCCAGCCGCATGGGTCCCTA
CAGGACGGACATCGTGGTCTCTGCATGCCAAAGGCGAATGGATGACCACAGAAG
ACATGCTTGAGGTCTGGAACCGTGTGTGGATAGAGGACAATCCACACATGGCCA
ACAAAACCCGCATAGGATCTTGGCAGGATATCCCATACCAACGCAAATCCCTGGA
TATACATTGTGGCTCAATGATAGGACAACGCTCCAGATCTACATGGGCTGCAAAT
ATACGCATAAGCATCAATCACGTGCGCAGGTTGATTGGGAGCAATGAAAAGTAC
CTGGATTACATGCAAGAGCAAGAGAGATTCAGGCAACCAACACCAACTCGGCTT
GGTAACGTGATCTAAAACCCTACAAAATTTCAAAAACATGACCGAGTCAGGCCTC
TACGGAGCCAGCATTAATGAGAGTAAGTGCTGCTGCCTGTGTCTCTCCAGAACAC
CTTACGCGCCAAATGTGTTCTGACACTATACCAGCGCAAAACTAGGCCCCACAAG
GGATAGGGTAATGGTTGTGAACCCCTAGCGTCTAAATCAACCTCATAGTGGAATG
GCGCCCGACCACTATAAAACATGGCACTAATAGAAGGGCAATGGGTAGCTCGAC
CCATTAAGTAAACACCCTATTAATATCGAGCATCATATCGACACCTGGGAAAGAC
CGGAGATACCTCTTGCTTCACAGCGCTCAATCCACAAGGCACAGTACGCCGAAGA
ATTGTGGATTGGGAATTGAGAAA

FIG. 62 cont.

>SEQ ID NO:387   LiCV Amino acid sequence
MVTKLRRPARRAVDMIRRAVPRAAGPRKVLTRVSNTMKRNAGALRALLAYLLFQTFAGRKVGTRARTALKRFNKNDI
VKMLLAFRRTLTNIITTMQRRVKGKNRRGLQEVSLVVTALMVVGVFSATLKTVGEYSWLNVTSNDVGKWIRVENRNG
RGECFVTATDVGTWCPDSVGYECPQVAPAYDPEDLDCYCRNTSTYVTYGRCKNGKNGRSRSKRSVTITPHGEAGLRV
GSTKHWTSRASPERYLMRVEKWVLRHPLPAFVLVILGWMMGRTHGQRIMYILLMLLVAPSYGNQCLDVQSRDFVQG
VSGGTWVDVVLDHDNCITIVADGKPSFDIRLTKMTMTKFADYKRYCLQATMTDVTSIVACPGAGDAHNDKSKNHDYI
CKAVTNDRGWGNGCVLFGKGSMETCGKFECKKKMAGKLVARENVESVVTVHVHGASATDTKGVDTASTATATITPK
SSTASVNLNDFGSVEVDCSTDVGMDFGEVVVADMAGKWWIVNKDWFNELALPWSTASVAAEVWQGRDRLIEFGWP
HAVKQNIYDIGDQEGAVTAAIAQAPMAKWESDKVELASGILKCKVKLGNLKLRGITYGMCTKSFNMETRPADTGHGT
VAFKLKYTGSDVPCRVPLNVIDSDGGVAAGRIITAHPFVMKQNDYIIIEVEPPFGDSKIEIGTGTTKLTEAWHRKGSSIGN
AFSATYKGITKLTVLGEHAWDFNSLGGFGASLGKAVHTLFGGVFRVLFGGMGWLTKILVGAILVWLGLGAHDKTIATT
MIVVGSMLMYLAVSVGALSEIGCSLDIARREMKCGDGVFIFREAGMWKEGYAFHPAEPKTLAASVLKSWKAGVCGVR
STSRMEHAMWKQIENELNGILEENEAHLSVVVKETNGTFPRGDRRMQVAEPLKYGWKTWGKTAVSTVPLAKETFIVD
GSDEGECPSQLRAWNSFQVEEFGTGLLKTKVFLDISTAVTVQCDTKLLGAAIKGNKSVHGDPGLWMVSAEIDGVWQIT
ELTLAESRRCMWPDSHTVWGRNVLESELILPPTYGGPVTNMNKRRGYATQVSGPWNHVPLKVVFEECPGTTVTIEPNC
TKRSESVRSTTDSGKIISDWCCRSCTMPPLTYRTPDGCWYAMEVRPKNVKEESLIRSHVAAGVFKGIDDVSLGLLVMIIF
LQEGLRRKLTTTYIMWAALVVLTAGILGELSLRDVLRYLILVGTAFSEANNGGDLIHLALVAVFKIRPAFLFGFLFRAKW
SPREGVLLASGALMLQIASECLYATAIMQVVDALSMGWLMIRAIAIPGMTSKAMPLLCACIPAVTSLLVHSTRVGVITL
AGMSLIAGNKGSSVKKHGPYLVALITTAMGASPVGMLAMEAFSHLKSRRSWPAGEMMSAVGLTCALVGAISGTSSHD
FAGPLAAAALIIIAYAISGRSADVYLEKAGEISWSEDAKISGSSPRIDVCVTENGDFKLRHEGEATWTRNCILAACLIVAG
VHPLGIPVAGLMWFGYVKANRRGTVLWDIPSPQTNAAPTVEDGCYRVMSKRLLGSTQLGVGIMLDSTFHTMWHITRG
ASIVSGEGRLDPYWADVKEDLVCYGGPWKIRNMWDGMSEVQLIAVPPKENPVNVQTMPGKFVVANGGEIGAVVLDY
PPGTSGSPIVDQQGNVIGLYGNGVMINDQTYASAIAQAPVEAARTPTWFSEDMLRKGQIHVLDLHPGAGKTRKVLPEIL
KAAVEKRLKTLVLAPTRVVAKEMHEALTGLPVRYQTSAIPPTSSGGELIDVMCHATYTHRQLTPGRGINYQLYIVDEAH
FTDPASIAARGIIATRVRLGHAAAIFMTATPPGMSNPFPESNAHIEDEEREVPTKAWNSGYEWITDYSGRTVWFVPSIRM
ANTIASCLVRAGKVVIVLHSGSFNEEYQKTKSGNWDFVVTTDISEMGANFKASRVIDSRLSIKPMFSYAPSERVVIGMPR
PVSPASAAQRRGRVGRDPRQLGDQYIYGGPIGEDSAEYVHWTEARILMDNVTVPGGLYPQFYEPESGMCNAMDGAHR
LTDTKREVFRDLMKKGELPVWLAYQVAQAGHAYTDRTWCYSGPADHQVYDDCGQTVDYRSLNGERRMLRPKWLD
QRTYNDKTSLRLFTEFAEGRRRYSELIDVFGRMPQHMLDKTILAADTFKDVLTATPGSRVHRLALDNLPEATETIMVLGI
LSVSTLGVILFLMSPKGMTRMTCGLVVIILATYFLWVSGMAGYQIAAVQLMAFVLFVVLVPEPGSQRSVQDNTIAIILIVI
LSLAAAIAANEAGLLEKTKKDFTWRKEKPTQLETSPWNIDFSMDLRPATSWSLYVVMATMLGPVLEHAIVTNYASVSL
TAITNQAGILLSMDKGTPFWNLDWSVVLLCVGSWSGINGTTLMVASVMTVLHFAMILPGIRAKAAREAQNRTAAGVS
KNPLVDGMNTINIQPLPELDPMYERKMGLWMLIAVAGAAVVFDKRMLHYTEFGVLGSAAITPLVEGYASAVWNTSVA
ASVCNLMRGHYMAGVPMAYSLIRNLSMKGVSRRGIQATRTLGMVWKHKLNTMDKAMFNAYKKDGITEVDREPARA
AMKKGDLVSGWAVSRGSAKLRWMHERGFIPLQGTVVDLGCGRGGWSYYAAAQRKVTSVKGLTKGGPGHEEPVNVQ
SYGWNLISFRSGVDVFHTDVQPADTLLCDIGESSSDPNLEKTRTLQVLVNFERWLKESKCENFCCKVLGPYLPEVMERL
DRLTKTYGGAVIRNPLSRNSTHEMYWVSGAKGNPVNAITTTSRVLLERMCRRVGKSYWEEDVNLGTGTRAVTCSAET
PDMSKIGRRIELLKKEYRASWFEDPEHPYKTWTYHGSYETKTTGSSSSMINGVVKEMTHPWDTNPRVTTVCMTDTTPF
GQQRVFKEKVDTKAREPSDGTREVMRIVSKWLTMYIGRTKKPRICTAEEFIAKVNSDAALGTMFDSQGTWANAREAV
QDPRFWQMVARERELHLRGQCATCVYNMMGKREKKMTEFGKSKGSRAIWFMWLGARFLEFESLGFLNEDHWLSREN
SGGGVEGIGLQYLGYVLRDMAAIPGGRMYADDTAGWDTRITNADLEDEMDILDLMDPHHKKLARNLMDLAYNNKV
VRVMRPGKGGKTLMDIISRKDQRGSGQVVTYPLNTWTNLKVQLIRMAEAEGVLDPREVEGITHTTKNSLEKWLTNHG
AERLKRVAASGDDVVVKPIDERFASALTYLNDMAKTRKDICEWKPSTGWYHWEEVPFCSHHFHQLMLKDGRTLVVPC
RDQDELIGRARVSPGAGWTIKETAGLSKAYAQMWLLMHFHRRDLRMAGFAICSAVPAAWVPTGRTSWSLHAKGEWM
TTEDMLEVWNRVWIEDNPHMANKTRIGSWQDIPYQRKSLDIHCGSMIGQRSRSTWAANIRISINHVRRLIGSNEKYLDY
MQEQERFRQPTPTRLGNVI

FIG. 63

>SEQ ID NO:388        BinJV/WNV$_{KUN}$-prME chimeric ISF vector
GGATCTACGAACGAGAATAAGTAGAAGAACGGAACGACAGAGTCAGGCCTCAAA
TGAGCCAGCATTAATGAGAGTAAGTGCTGCTGCCTGTGCCTCTCCTTAACACGTG
GTAGCGCCACTCGTGTTTCGTTACCTAATAGCGCTAGAGTCAGACCCAAGTAGGC
CAGGGCTATGGTTGTAAGCCCTGCTGTCTGTGGCAGCCATCCAGTGGTAATGCGT
CGCACCACTAAGGATTAATAGACGTATATTGGGAGGGACTGGTGAGGAGCAGCA
AGCTCGAGCTGCATCACCCACTGGTACTATCGGTTAGAGGAAACCCCCTCCAAAA
TGTAGAGCATCATATCGACACCTGGGAAAGACCGGAGATACCTCTTGCTTCACAG
CACTCAATCCACAAGGCACAGATCGCCGAATAATTGTGGATTGGGGATTGAGAA
ACATCAAGTATCTGGGTCGGCATGGCATCTCCACCTCCTCGCGGTCCGACCTGGG
CATCCGAAGGAGGACGTCGTCCACTCGGATGGCTAAGGGAGAGCCACTTTTCTCT
CGATTCTCTATCGGAATCTAGGGAGCTCGGATCCAGACATGATAAGATACATTGA
TGAGTTTGGACAAACCACAACTAGAATGCAGTGAAAAAAATGCTTTATTTGTGAA
ATTTGTGATGCTATTGCTTTATTTGTAACCATTATAAGCTGCAATAAACAAGTTAA
CAACAACAATTGCTCGAGGGGGGGCCCGGTACCTTGAAGCTGTCCCTGATGGTCG
TCATCTACCTGCCTGGACAGCATGGCCTGCAACGCGGGCATCCCGATGCCGCCGG
AAGCGAGAAGAATCATAATGGGGAAGGCCATCCAGCCTCGCGTCGGCGCTTAAG
GATCATGATGATAAACAATGTATGGTGCTAATGTTGCTTCAACAACAATTCTGTT
GAACTGTGTTTTCATGTTTGCCAACAAGCACCTTTATACTCGGTGGCCTCCCCACC
ACCAACTTTTTTGCACTGCAAAAAAACACGCTTTTGCACGCGGGCCCATACATAG
TACAAACTCTACGTTTCGTAGACTATTTTACATAAATAGTCTACACCGTTGTATAC
GCTCCAAATACACTACCACACATTGAACCTTTTTGCAGTGCAAAAAAGTACGTGT
CGGCAGTCACGTAGGCCGGCCTTATCGGGTCGCGTCCTGTCACGTACGAATCACA
TTATCGGACCGGACGAGTGTTGTCTTATCGTGACAGGACGCCAGCTTCCTGTGTT
GCTAACCGCAGCCGGACGCAACTCCTTATCGGAACAGGACGCGCCTCCATATCAG
CCGCGCGTTATCTCATGCGCGTGACCGGACACGAGGCGCCCGTCCCGCTTATCGC
GCCTATAAATACAGCCCGCAACGATCTGGTAAACAGTATATTTTGCGTGTGCGTT
TCAAAACACAGATTGTATTGAAAGTACGTAAGAGTATAACACGTTGGAATAAAG
TTTTGGATCAAGAGGAAAATCATGGTTACAAAACTCAGGAGGCCCGTTAAACGG
GCCGTCGATATGATGAGGCGCGCGGTACCCCGCGCCGCAGGACCCCGGCGGGTC
CTAACTAGGGTATCAAATACCGTGAAGCGTAACGCAGGCGCTCTTAGAGCTCTTC
TGGCTTATCTGCTGTACCAGACATTCTCTGGGCGGAAAGTTGGTAGTGGTGCTCG
GAGCGCCCTTAAGCGCTTCAACAAAAATGACATTGTGAAAATGTTGCTGGCGTTC
AGACGGACATTGACAAACATCATCACAACCATGCAGCGTCGTGTGAAAGGAAAG
AAACGTCGTGGCGTTCAAGATGTGCCGCTATTGGTCTTGCTGCTCGTTGGAGCAG
GAGCGATGGCTGTCACTCTCTCCAACTTTCAAGGGAAGGTGATGATGACGGTGAA
CGCTACTGACGTCACAGACATTATCACGATACCAACGGCCGCTGGAAAGAACCTG
TGCATTGTCAGAGCTATGGATGTGGGGCACATGTGTGATGATACTATCACCTATG
AATGTCCAGTGTTGTCGGCCGGAAATGATCCAGAAGACATTGACTGCTGGTGCAC
GAAGTTAGCAGTCTACGTTAGGTATGGAAGATGCACCAAGACACGACACTCAAG
ACGCAGCAGAAGGTCACTAACAGTGCAGACGCATGGAGAGAGCACCCTATCGAA
CAAAAAGGGGGCCTGGATGGACAGCACCAAGGCTACAAGGTACTTGGTAAAAAC
AGAATCATGGATCTTGAGAAACCCTGGATATGCCTTGGTGGCAGCTGTCATTGGA
TGGATGCTCGGAAGCAACACCATGCAGCGTGTCGTGTTTGCCGTGTTACTGCTTTT
GGTAGCTCCAGCTTACAGCTTTAACTGTCTTGGAATGAGCAACAGAGATTTCCTG
GAGGGAGTGTCCGGAGCAACATGGGTGGACTTGGTCCTTGAAGGTGACAGCTGT
GTGACCATTATGTCCAAGGACAAGCCCACCATCGATGTGAAGATGATGAACATG

FIG. 64

```
GAGGCCGCTAACTTAGCAGAAGTCCGCAGTTATTGCTACTTAGCCACTGTCAGTG
AACTCTCCACCAAGGCTGCGTGCCCAACCATGGGGGAAGCCCATAATGACAAGC
GGGCTGACCCATCTTTTGTGTGCAAACAAGGAGTAGTGGATAGAGGTTGGGGCA
ATGGGTGCGGACTTTTTGGTAAAGGAAGCATCGACACATGCGCCAAATTTGCCTG
TTCAACCAAGGCAACGGGAAGGACTATCTTAAAGGAGAACATTAAGTATGAGGT
GGCTATCTTTGTGCATGGACCAACTACCGTGGAATCGCATGGGAACTACTTCACG
CAAACCGGAGCTGCTCAGGCTGGGAGATTTAGTATCACCCCCGCGGCACCCTCTT
ACACTCTTAAGCTCGGAGAGTATGGAGAAGTAACAGTGGACTGTGAACCACGCT
CAGGGATAGACACCAGTGCATACTATGTGATGACTGTCGGGACAAAGACTTTCTT
GGTCCACCGTGAGTGGTTTATGGACCTCAACCTCCCCTGGAGCAGTGCTGAAAGT
AATGTTTGGAGGAACAGAGAGACGCTAATGGAGTTTGAAGAACCACACGCTACG
AAGCAATCTGTGATAGCATTGGGCTCTCAAGAGGGAGCCCTGCATCAAGCTCTGG
CAGGAGCCATTCCTGTGGAATTTTCAAGCAACACTGTCAAGCTGACGTCAGGCCA
CCTGAAGTGTAGGGTGAAGATGGAAAAATTGCAGCTGAAGGGGACAACTTATGG
CGTCTGTTCAAAGGCCTTCAGATTCTTGGGACTCCCGCAGACACGGGCCATGGT
ACTGTGGTACTGGAACTGCAGTACACAGGCACGGATGGACCCTGCAAGATACCC
ATTTCATCAGTAGCTTCATTGAATGACCTAACGCCAGTGGGCAGGTTAGTTACCG
TCAACCCCTTTGTCTCCGTGTCAACGGCCAATGCTAAAGTCCTGATTGAGTTGGA
ACCACCCTTTGGAGATTCGTACATAGTGGTGGGAAGAGGAGAGCAACAGATCAA
CCATCACTGGCACAAGTCTGGAAGTAGCATTGGCAAAGCTTTCACAGCCACCCTC
AAGGGAGCTCAGAGACTAGCAGCTCTGGGAGACACAGCTTGGGACTTTGGATCG
GTTGGAGGAGTGTTTACCTCCGTGGGAAAGGCTGTCCATCAAGTATTTGGTGGAG
CATTCCGCTCATTGTTTGGAGGCATGTCTTGGATAACTCAGGGTCTGCTGGGGGC
CCTCCTATTGTGGATGGGTATTAACGCTCGTGATAGATCCATAGCCCTCACGTTCC
TCGCGGTTGGAGGAGTTCTGCTCTTTCTCTCCGTGAACGTGCATGCTCTATCGGAA
ATAGGATGCAGTCTGGACATTAGCCGAAAAGAAATGAAGTGTGGGGACGGAGTC
TTCATCTTCAGAGAGGCAGGCATGTGGAAGGATGGGTATGCGTTCCACCCTTCCG
AACCCAAATCTCTGGCCGCGTCAGTTCTCAAGAGTTGGCAGTCTGGAGTGTGCGG
CGTGCGCTCCACGAACAGAATGGAACATGCCATGTGGAAACAGATTGAAAATGA
ATTGAACGGCATTCTAGAAGAGAATGAGGCGCAACTCAGCGTGGTTGTGCGAGA
GTCTAACGGGACCTTCCCGAGAGGAGAGCGCCGCATGCACGTGGCCGAACCTCT
GCGCTATGGATGGAAGACCTGGGGAAAGACCGCAATTTCGACGGTGCCGCTCGC
TAAAGAAACGTTTGTGGTAGATGGCAATGATGAAGGAGAATGTCCCTCTCAAATG
CGTGCTTGGAATTCCTTCCAAGTTGAAGAGTTCGGAACTGGGCTGGTGAAAACCA
AAGTGTTCTTGGACATATCCACTGCTCTCACCGCCCAATGTGACACCAAAATGCT
GGGCGCTGCCATAAAGGGGAATAGGTCTGTTCATGGAGATCCAGGTCTCTGGATG
GTCTCAGCTGAAATCGATGGGACATGGCAGATAATAGAGCTCACATTGGCAGAG
AGCAGGCGTTGCACATGGCCAGACTCTCACACCGTGTGGGGTAGGAATGTCCAG
GAGAGTGAGTTGATACTGCCACCGTCTTTCGGAGGACCGATGACCAACATGAACA
AGCGTAAAGGCTACGCGACCCAAGTGGGAGGACCATGGAACCATGTTCCACTAC
GAGTAGTTTTTGAAGAGTGTCCGGGAACCACTGTATCTGTTGAACCAAACTGCAC
CAGGAGATCGGATTCAGTGCGATCCACAACTGATAGCGGCAAGATTATAACCGA
CTGGTGTTGTCGTTCCTGTACAATGCCTCCCTAACGTACCGAACCCCCGATGGAT
GCTGGTATGCAATGGAAATCAGGCCCAAGAATGTTAAAGAGGAGAGTCTGATCC
GTTCGCATGTGGCGGCAGGTGTGTTTAAAGGCATTGACGACGTGTCACTGGGGCT
GTTAGTAATGATAATTTTCCTGCAGGAAGGTTTGAGAAGAAAGTTAACTGCAACG
TATATCATGTGGGCTGCTCTTGTGGTCCTCATTGCAGGAATCCTAGGGGAACTCA
CAGTGAGGGATGTGCTCAGGTATCTCATCCTAGTCGGCACTGCATT
```

FIG. 64 cont

```
CGCTGAGAGTAATAATGGAGGAGATTTAATACATCTGGCCCTAGTGGCGGTCTTC
AAGATTAGGCCGGCATTCTTATTTGGATTCTTGTTCAGGAGTCAGTGGTCCCCAG
AGAAGGTGTGTTGCTGGCATCTGGAGCGCTGATGCTGCAGATTGCAAGTGAGTGC
TTGCACGCATCGGCGATTATGCAGGTTGTCGATTCCTTGAGCATGGGGTGGTTGA
TGATCAGAGCCATTGCTGTACCTGGTATGACCTCAAAAGCCATGCCACTGCTGTG
TGCCTGCATTCCTGCAGTTACGAGCCTACTGGCCCACTCAACCAGAGCCGGTATA
ATCACCATGGCCGGCATGTCGCTTATTGCAGGAAGTAAGGGATCATCAGTTAAAA
AACACAGTCCATACATGCTTGCCCTCGTGGTGGCAGGCCTCGGAGCCCGTCCCAT
AGGAATGTTGGCGATGGAAGCCTTCTCTCACCTGAAGGGCCGGAGATCATGGCCG
GCTGGTGAGATGATGTCAGCCGTTGGGCTGACATGTGCGCTAGTGGGAGCTATCA
GTGGCGCATCATCTCAGGACTTCGCCGGACCTCTAGCAGCAGCGGCTCTAATTAT
TATTGCATATGCCATTAGTGGACGCTCAGCTGATGTATACCTTGAGAAAGCCGGT
GAGATATCCTGGAGTGAGGACGCTAAAATATCCGGATCAAGCCCGCGCATTGAT
GTGTGCGTTACCGAAAATGGAGATTTCAAATTGCGTCATGAGAGTGAAGCAACCT
GGACCCGGAATTGTGTCTTGGCTGCTTGCTTAGTCGTAGCCGGAGTGCACCCACT
GGGGATTCCAGTAGCAGGGTTGATGTGGTTTGGATATGTGAAATCAAACAAGCG
GGGGACTGTGTTGTGGGACATTCCCTCACCACAGGCAACATCAGCTCCAACGGTG
GAAGATGGATGCTACCGCGTTATGTCACGTAGACTGCTTGGCAGCACTCAGCTTG
GTGTTGGGATCATGCTAGACTCTACATTTCACACAATGTGGCACATAACCCGAGG
AGCATCTATTGTTAGTGGTGAAGGGCGTCTTGACCCATATTGGGCTGACGTTAAG
GAAGACCTGGTCTGTTACGGAGGGCCATGGAAAATCCGCAACACATGGGATGGA
CTCTCAGAAGTTCAGCTGATAGCGGTGGCCCCAAAAGAGAATCCCGTGAACGTCC
AAACAATGCCAGGAAAGTTCATTGTGGCGAATGGAGGTGAGATAGGAGCCGTTG
TGCTCGACTATCCTCCTGGAACTTCTGGTTCACCCATCGTGGATCAGCAGGGTAAT
GTCATAGGACTGTATGGCAACGGGGTTATGATCAATGACCAAACGTATGCGAGTG
CCATTGCGCAAGCTCCAGCTGAAGTTGCGCGCACCCCAACCTGGTTCACTGATGA
TATGTTGCGAAAGGGACAATTGCATGTGCTAGACTTGCACCCTGGAGCGGGAAA
AACCCGCAAGGTCCTGCCTGAGATTCTCAAAGCAGCGGTGGAGAAACGGCTACG
CACGTTGGTCCTGGCCCCAACCAGAGTTGTGGCAAAGGAAATGCATGAAGCATTG
ACCGGGCTGCCGGTACGCTACCAGACATCAGCAGTGGCACCAAATGGTTCTGGA
GGAGAATTGATTGATGTCATGTGCCATGCAACATACACACACCGCCAGCTGACAC
CGGGACGGGGGGTCAACTACCAGTTATACATAGTGGATGAGGCACATTTTACAG
ATCCCGCTTCCATCGCAGCTCGCGGCATCATTGCGACTAGGGTGCGATTGGGACA
TGCCGCAGCAATCTTCATGACGGCCACACCCCGGGAATGTCAAACCCATTCCCG
GAGTCTAATGCTCACATTGAAGACGAAGAGCGGGAGGTACCCACCAAAGCTTGG
AACGCTGGATATGAGTGGATAACAGACTATGGGGGAAAAACCGTGTGGTTCGTG
CCTTCCATCCGGATGGCGAACACCATAGCTGCATGCTTGGTACGAGCAGGCAAGA
CAGTCATTGTACTGCACAGTGGCTCTTTCAATGAAGAATATCAAAAAACCAAGTC
TGGCAATTGGGATTTCGTTGTGACGACCGACATCTCAGAAATGGGGGCCAATTTC
AAAGCCTCTAGGGTCATAGACTCTAGACTGTCCATAAAACCGATGTTTTCCTACG
CTCCCAGTGAGCGAGTGGTTATTGGCTCACCTAGAGCGGTTTCTCCAGCCAGCGC
AGCACAGCGCCGAGGGAGAGTCGGGAGAGACCCTCGTCAACTGGGCGACCAGTA
TATCTATGGTGGACCAGTAGGAGAAGACTCGGCCGAGTTCGTTCATTGGAAGGAA
GCAAGGATCCTCATGGATAATGTAACTGTCCCTGGGGCTTGTATCCACAATTCT
ACGAACCAGAGGGTGGAATGTGTGACGCCATGGATGGAGCTCACCGACTGACCG
ATGCTAAGAGAGAAGTGTTCCGAGACCTCATGAAGAAGGGGAACTTCCTGTAT
GGTTAGCATACCAGGTGGCCCAGGCTGGGCATGCGTACACTGACAGAACTTGGTG
CTATGGGGGGCCGGCGGATCATCAAGTGTATGATGATTGCGGCCAAACCGTGGAT
TACAGGTCCCTTAATGGAGAGAGGCGTATGCTACGTCCCAAGTGGCTTGATCAGC
GCACCTACAACGACAAAACATCCTTAAGGCTCTTCACGGAATTTGCAGAGGGACG
CCGCCGATATTCGGAACTAATGGACGTGTTTGGAAGAATGCCCCAACACATGTTG
```

FIG. 64 cont.

```
GACAGGACCATCTTGGCTGCAGACACGTTTAAAGATGTCCTGACAGCAACACCGG
GATCTCGTGTGCACCGTTTAGCACTGGACAATTTACCCGAAGCTACAGAAACTAT
GATGGTAGTGGGAATCCTGAGTGTCTCGACCCTAGGCGTTATGCTATTTCTGATGT
CACCCAAGGGCATGACCCGGATGACCTGCGGACTTGTGGTGATCATCCTGGCGAC
GTATTTTCTATGGGTGTCAGGAATGGCCGGCTACCAGATAGCAGCAATGCAACTC
ATCGCGTTCATTCTGTTTGTGGTCTTGGTGCCAGAGCCAGGGTCACAGAGATCAG
TGCAAGACAACACCATAGCGATAATTCTCATAGTCATCCTGTCGTTGGCTGCCAT
CATAGCCGCCAATGAAGCAGGATTGCTAGAGAAGACCAAAAAGGATTTCGCGTG
GAAGAGGGAGAGTCATGTGCTGGTGACTCCGAGTCCGTGGAACCTGGATTTCTCA
ATGGATTTGAGGCCAGCCACCAGCTGGTCATTGTATGTGGTGATGGCCACCATGT
TAGGGCCAGTACTGGAACACGCCATTGTCACCAATTATGCTAGCGTCTCACTTAC
TGCCATCACAAACCAGGCAGGAATACTGCTGTCAATGGATAAGGGCACTCCTTTC
TGGAATCTTGACTGGAGTGTTGTCCTGTTGTGCGTGGGCAGCTGGTCGGGGATCA
ATGGCACTACACTAATGGTTGCTTCCACAATGACAGTTTTGCATTTTGCCATGATA
CTACCTGGCATTCGTGCCAAAGCGGCGAGAGAAGCACAGAATCGAACAGCAGCT
GGGGTGTCAAAGAACCCTCTTATTGATGGGTTAAACACCATAAACATCCAGCCGT
TGCCGGAAATGGACCCCATGTACGAAAGGAAAATGGGGCTATGGATGCTAATCG
CTGTTGCCGGAGCCGCGGTGGTTTTGACAAGAGAATGCTCCATTACACCGAGTT
CGGAGTATTGGGTTCAGCTGCTGTGAGTCCTCTCATTGAAGGATACGCGTCTGCT
GTTTGGAACACTTCCGTAGCAGCCAGTGTGTGCAACCTAATGCGAGGCCATTACA
TGGCGGGAATCCCAATGGCATACTCTCTGATCAGAAATCTATCCATGAAAGGAGT
TCCTAGGAGGGGATTACAGGCCACCCATACCCTTGGTATGGTTTGGAAACACAAA
TTAAACGCCATGGACAAGGCGGCCTTTAACGCATACCGGAAGGATGGAGTGACA
GAAGTGGATAGGGAGCCAGCACGTGAAGCTATGAAGAAAGGAGATTTGGTGAGC
GGATGGGCGGTCTCTCGAGGGTCAGCCAAGCTGCGATGGATGCACGAGCGTGGA
TACATTCCCCTACAAGGAGTTGTCATTGACCTCGGATGTGGAAGAGGGGGTGGA
GTTACTACGCTGCTGCACAACGCCGGGTGACCGCTGTCAAAGGGCTCACGAAAG
GCGGACCAGGGCATGAGGAGCCAATCAACGTCCAGTCATATGGATGGAACTTAG
TGACGTTCCGTAGTGGAGTGGATGTCTTTCACACCGAAGTCCAGCCGGCTGACAC
CCTGTTGTGCGACATAGGAGAGTCTTCTGCTGACCCCGCTGTCGAAAAAGCGCGC
ACAGTACAAGTGTTGGTGAACTTTGAAAGATGGATTAGAGAGTCGCGGTGTGAG
CATTTTTGTTGCAAGGTGCTTGGTCCCTACTCTCCCGAAGTGATGGAGCGCTTAGA
TCGTTTAACAAAGACATATGGAGGAGCGGTAATTCGCAACCCACTATCCAGGAAC
TCCACGCATGAGATGTACTGGGTGTCAGGAGCTAAGGGTAATCCAGTCAATGCTA
TAACAGCCACCTCACGTGTGCTAATCGAACGCATGTACAGAAGACTTGGCAAGA
GTTACTGGGAAGAAGATGTGAATCTTGGTACTGGGACCCGTGCAGTTTCATGTGC
CGCGGAGAAGCCAGATCTAGCAAAAATCGGAAGGCGCATTGAGTTGCTGAAGAA
GGAGTATAAAGCATCATGGTTCGAGGATCCAGAGCATCCCTACAAGACATGGAC
ATACCATGGTTCCTACGAAACCAAGACCACAGGCAGCTCGTCTAGTATGATTAAT
GGCGTTGTCAAGGAGATCACTCACCCTTGGGATACCAACCCAAGGGTTACAACCG
TCTGTATGACCGACACCACTCCTTTTGGACAGCAGAGAGTATTCAAGGAAAAGGT
AGATACCAAGGCACGTGAGCCATCTCAAGGGACGCGGGAGATCATGAGAATAGT
GAGCAAGTGGCTCACACTATATATTGGTCGGAGCAAGCGCCCTAGGCTGTGCACA
GCGGATGAATTCATAGCCAAAGTTAATGCTGATGCCGCTCTCGGCACGATGTTCG
ACTCGCAGGGAAACTGGGCGAACGCCAAAGAAGCTGTGCGCGACCCACGGTTTT
GGCAGTTGGTGGCCAAAGAGAGGGAACTTCACCTGCGTGGACAGTGTGCCACGT
GTGTTTACAACATGATGGGGAAGCGAGAGAAAAAGCTGACAGAG
```

FIG. 64 cont.

TTTGGGAAGTCGAAGGGGAGCCGAGCAATTTGGTTTATGTGGCTAGGAGCTAGGT
TCTTGGAGTTTGAAAGTTTAGGCTTCCTAAACGAGGATCATTGGTTGTCACGTGA
AAACTCAGGAGGTGGAGTTGAGGGCATTGGATTGCAATACCTTGGGTATGTGTTG
AAAGAAATGGCACTAATTCCCGGGGGCAAGATGTACGCCGATGACACCGCTGGG
TGGGACACCAGAATTACTAACGCTGACCTTGAGGATGAGATGGACATATTGGGA
CTTATGGACCCGCATCACAAAAAACTGGCAAAAAATCTGATGGAGTTGGCGTAC
AACAACAAGGTGGTCAGAGTGATGCGCCCTGGTAAAGGGGGAAAAACACTAATG
GACATCATTAGCCGCAAGGACCAGCGGGGAAGTGGACAAGTGGTCACCTACCCA
CTCAACACGTGGACGAATCTCAAGGTCCAATTGATCCGTATGGCAGAGTCAGAGG
GAGTGTTGGACCCCAAGGAGATCGATGGAATCACTGTCACGACTCGGAATAACCT
GGAAAAATGGCTCACTAGCCAAGGGGCTGAGCGTCTAAAGCGCATTGCAGCTAG
CGGTGACGACGTTGTGGTAAAACCAGTGGATGAGAGATTCGCCAATGCTCTCACC
TATCTAAACGACATGGCCAAAATTAGGAAGGACATCAGTGAGTGGAAACCATCC
GCGGGGTGGTTCCACTGGGAAGAAGTGCCATTCTGCTCACACCATTTTCACCAGT
TGGTCCTCAAGGATGGGCGCACCTTAGTGGTCCCATGCCGTGACCAGGATGAACT
AATTGGAAGGGCAAGAGTGTCACCTGGTGCTGGATGGACTATCAGAGAAACTGC
AGGTCTAAGCAAGGCCTATGCCCAGATGTGGCTTCTAATGCACTTCCACCGGAGG
GACCTCAGAATGGCAGGTTTCGCCATTTGTAGTGCTGTCCCCAGTGATTGGGTGC
CCACGGGAAGGACATCGTGGTCACTGCACGCTAAAGGGGAGTGGATGACCACTG
AAGACATGTTAGCAGTTTGGAACAGAGTGTGGATTGAAGACAATCCCCACATGTC
TAACAAGACTTTAGTGGGATCATGGAAGACATCCCGTACCAGAGGAAATCCCTG
GACATCCACTGTGGCTCAATGATAGGGCAGCGGTCTAGGTCAACATGGGCTGCTA
ACATACGAATTAGCATTGGACACGTGCGCCGATTGATTGGAACCACGGAAAAGT
ACTTGGATTACATGCAGGAGCAGGAGCGGTTCAAGATTGCTGAACCAACCCGTCT
GGGCAATGTGATCTAA

FIG. 64 cont.

\>SEQ ID NO:389    BinJV/WNV$_{KUNV}$-prME ORF aa sequence

MVTKLRRPVKRAVDMMRRAVPRAAGPRRVLTRVSNTVKRNAGALRALLAYLLYQTFSGRKVGSGARSALKRFNKND
IVKMLLAFRRTLTNIITTMQRRVKGKKRRGVQDVPLLVLLLVGAGAMAAEVTRRGSAYYMYLDRNDAGEAISFPTTLG
MNKCYIQIMDLGHMCDATMSYECPMLDEGVEPDDVDCWCNTTSTWVVYGTCHHKKGEARRSRRAVTLPSHSTRKLQ
TRSQTWLESREYTKHLIRVENWIFRNPGFALAAAAIAWLLGSSTSQKVIYLVMILLIAPAYSIRCIGVSNRDFVEGMSGGT
WVDVVLEHGGCVTVMAQDKPTVDIELVTTTVSNMAEVRSYCYEASISDMASDSRCPTQGEAYLDKQSDTQYVCKRTL
VDRGWGNGCGLFGKGSLVTCAKFACSKKMTGKSIQPENLEYRIMLSVHGSQHSGMIVNDTGHETDENRAKVEITPNSP
RAEATLGGFGSLGLDCEPRTGLDFSDLYYLTMNNKHWLVHKEWFHDIPLPWHAGADTGTPHWNNKEALVEFKDAHA
KRQTVVVLGSQEGAVHTALAGALEAEMDGAKGRLSSGHLKCRLKMDKLRLKGVSYSLCTAAFTFTKIPAETLHGTVT
VEVQYAGTDGPCKVPAQMAVDMQTLTPVGRLITANPVITESTENSKMMLELDPPFGDSYIVIGVGEKKITHHWHRSGST
IGKAFEATVRGAKRMAVLGDTAWDFGSVGGALNSLGKGIHQIFGAAFKSLFGGMSWFSQILIGTLLMWLGLNTKNGSI
SLMCLALGGVLIFLSTAVSALSEIGCSLDISRKEMKCGDGVFIFREAGMWKDGYAFHPSEPKSLAASVLKSWQSGVCGV
RSTNRMEHAMWKQIENELNGILEENEAQLSVVVRESNGTFPRGERRMHVAEPLRYGWKTWGKTAISTVPLAKETFVV
DGNDEGECPSQMRAWNSFQVEEFGTGLVKTKVFLDISTALTAQCDTKMLGAAIKGNRSVHGDPGLWMVSAEIDGTWQ
IIELTLAESRRCTWPDSHTVWGRNVQESELILPPSFGGPMTNMNKRKGYATQVGGPWNHVPLRVVFEECPGTTVSVEPN
CTRRSDSVRSTTDSGKIITDWCCRSCTMPPLTYRTPDGCWYAMEIRPKNVKEESLIRSHVAAGVFKGIDDVSLGLLVMII
FLQEGLRRKLTATYIMWAALVVLIAGILGELTVRDVLRYLILVGTAFAESNNGGDLIHLALVAVFKIRPAFLFGFLFRSQ
WSPREGVLLASGALMLQIASECLHASAIMQVVDSLSMGWLMIRAIAVPGMTSKAMPLLCACIPAVTSLLAHSTRAGIIT
MAGMSLIAGSKGSSVKKHSPYMLALVVAGLGARPIGMLAMEAFSHLKGRRSWPAGEMMSAVGLTCALVGAISGASSQ
DFAGPLAAAALIIIAYAISGRSADVYLEKAGEISWSEDAKISGSSPRIDVCVTENGDFKLRHESEATWTRNCVLAACLVV
AGVHPLGIPVAGLMWFGYVKSNKRGTVLWDIPSPQATSAPTVEDGCYRVMSRRLLGSTQLGVGIMLDSTFHTMWHITR
GASIVSGEGRLDPYWADVKEDLVCYGGPWKIRNTWDGLSEVQLIAVAPKENPVNVQTMPGKFIVANGGEIGAVVLDY
PPGTSGSPIVDQQGNVIGLYGNGVMINDQTYASAIAQAPAEVARTPTWFTDDMLRKGQLHVLDLHPGAGKTRKVLPEI
LKAAVEKRLRTLVLAPTRVVAKEMHEALTGLPVRYQTSAVAPNGSGGELIDVMCHATYTHRQLTPGRGVNYQLYIVD
EAHFTDPASIAARGIIATRVRLGHAAAIFMTATPPGMSNPFPESNAHIEDEEREVPTKAWNAGYEWITDYGGKTVWFVP
SIRMANTIAACLVRAGKTVIVLHSGSFNEEYQKTKSGNWDFVVTTDISEMGANFKASRVIDSRLSIKPMFSYAPSERVVI
GSPRAVSPASAAQRRGRVGRDPRQLGDQYIYGGPVGEDSAEFVHWKEARILMDNVTVPGGLYPQFYEPEGGMCDAMD
GAHRLTDAKREVFRDLMKKGELPVWLAYQVAQAGHAYTDRTWCYGGPADHQVYDDCGQTVDYRSLNGERRMLRP
KWLDQRTYNDKTSLRLFTEFAEGRRRYSELMDVFGRMPQHMLDRTILAADTFKDVLTATPGSRVHRLALDNLPEATET
MMVVGILSVSTLGVMLFLMSPKGMTRMTCGLVVIILATYFLWVSGMAGYQIAAMQLIAFILFVVLVPEPGSQRSVQDN
TIAIILIVILSLAAIIAANEAGLLEKTKKDFAWKRESHVLVTPSPWNLDFSMDLRPATSWSLYVVMATMLGPVLEHAIVT
NYASVSLTAITNQAGILLSMDKGTPFWNLDWSVVLLCVGSWSGINGTTLMVASTMTVLHFAMILPGIRAKAAREAQNR
TAAGVSKNPLIDGLNTINIQPLPEMDPMYERKMGLWMLIAVAGAAVVFDKRMLHYTEFGVLGSAAVSPLIEGYASAV
WNTSVAASVCNLMRGHYMAGIPMAYSLIRNLSMKGVPRRGLQATHTLGMVWKHKLNAMDKAAFNAYRKDGVTEV
DREPAREAMKKGDLVSGWAVSRGSAKLRWMHERGYIPLQGVVIDLGCGRGGWSYYAAAQRRVTAVKGLTKGGPGH
EEPINVQSYGWNLVTFRSGVDVFHTEVQPADTLLCDIGESSADPAVEKARTVQVLVNFERWIRESRCEHFCCKVLGPYS
PEVMERLDRLTKTYGGAVIRNPLSRNSTHEMYWVSGAKGNPVNAITATSRVLIERMYRRLGKSYWEEDVNLGTGTRA
VSCAAEKPDLAKIGRRIELLKKEYKASWFEDPEHPYKTWTYHGSYETKTTGSSSSMINGVVKEITHPWDTNPRVTTVCM
TDTTPFGQQRVFKEKVDTKAREPSQGTREIMRIVSKWLTLYIGRSKRPRLCTADEFIAKVNADAALGTMFDSQGNWAN
AKEAVRDPRFWQLVAKERELHLRGQCATCVYNMMGKREKKLTEFGKSKGSRAIWFMWLGARFLEFESLGFLNEDHW
LSRENSGGGVEGIGLQYLGYVLKEMALIPGGKMYADDTAGWDTRITNADLEDEMDILGLMDPHHKKLAKNLMELAY
NNKVVRVMRPGKGGKTLMDIISRKDQRGSGQVVTYPLNTWTNLKVQLIRMAESEGVLDPKEIDGITVTTRNNLEKWLT
SQGAERLKRIAASGDDVVVKPVDERFANALTYLNDMAKIRKDISEWKPSAGWFHWEEVPFCSHHFQLVLKDGRTLV
VPCRDQDELIGRARVSPGAGWTIRETAGLSKAYAQMWLLMHFHRRDLRMAGFAICSAVPSDWVPTGRTSWSLHAKGE
WMTTEDMLAVWNRVWIEDNPHMSNKTLVGSWQDIPYQRKSLDIHCGSMIGQRSRSTWAANIRISIGHVRRLIGTTEKY
LDYMQEQERFKIAEPTRLGNVI

FIG. 65

>SEQ ID NO:390    BinJV/ZIKV-prME chimeric ISF vector
GGATCTACGAACGAGAATAAGTAGAAGAACGGAACGACAGAGTCAGGCCTCAAA
TGAGCCAGCATTAATGAGAGTAAGTGCTGCTGCCTGTGCCTCTCCTTAACACGTG
GTAGCGCCACTCGTGTTTCGTTACCTAATAGCGCTAGAGTCAGACCCAAGTAGGC
CAGGGCTATGGTTGTAAGCCCTGCTGTCTGTGGCAGCCATCCAGTGGTAATGCGT
CGCACCACTAAGGATTAATAGACGTATATTGGGAGGGACTGGTGAGGAGCAGCA
AGCTCGAGCTGCATCACCCACTGGTACTATCGGTTAGAGGAAACCCCCTCCAAAA
TGTAGAGCATCATATCGACACCTGGGAAAGACCGGAGATACCTCTTGCTTCACAG
CACTCAATCCACAAGGCACAGATCGCCGAATAATTGTGGATTGGGGATTGAGAA
ACATCAAGTATCTGGGTCGGCATGGCATCTCCACCTCCTCGCGGTCCGACCTGGG
CATCCGAAGGAGGACGTCGTCCACTCGGATGGCTAAGGGAGAGCCACTTTTCTCT
CGATTCTCTATCGGAATCTAGGGAGCTCGGATCCAGACATGATAAGATACATTGA
TGAGTTTGGACAAACCACAACTAGAATGCAGTGAAAAAAATGCTTTATTTGTGAA
ATTTGTGATGCTATTGCTTTATTTGTAACCATTATAAGCTGCAATAAACAAGTTAA
CAACAACAATTGCTCGAGGGGGGCCCGGTACCTTGAAGCTGTCCCTGATGGTCG
TCATCTACCTGCCTGGACAGCATGGCCTGCAACGCGGGCATCCCGATGCCGCCGG
AAGCGAGAAGAATCATAATGGGGAAGGCCATCCAGCCTCGCGTCGGCGCTTAAG
GATCATGATGATAAACAATGTATGGTGCTAATGTTGCTTCAACAACAATTCTGTT
GAACTGTGTTTTCATGTTTGCCAACAAGCACCTTTATACTCGGTGGCCTCCCCACC
ACCAACTTTTTTGCACTGCAAAAAAACACGCTTTTGCACGCGGGCCCATACATAG
TACAAACTCTACGTTTCGTAGACTATTTTACATAAATAGTCTACACCGTTGTATAC
GCTCCAAATACACTACCACACATTGAACCTTTTTGCAGTGCAAAAAAGTACGTGT
CGGCAGTCACGTAGGCCGGCCTTATCGGGTCGCGTCCTGTCACGTACGAATCACA
TTATCGGACCGGACGAGTGTTGTCTTATCGTGACAGGACGCCAGCTTCCTGTGTT
GCTAACCGCAGCCGGACGCAACTCCTTATCGGAACAGGACGCGCCTCCATATCAG
CCGCGCGTTATCTCATGCGCGTGACCGGACACGAGGCGCCCGTCCCGCTTATCGC
GCCTATAAATACAGCCCGCAACGATCTGGTAAACAGTATATTTTGCGTGTGCGTT
TCAAAACACAGATTGTATTGAAAGTACGTAAGAGTATAACACGTTGGAATAAAG
TTTTGGATCAAGAGGAAAATCATGGTTACAAAACTCAGGAGGCCCGTTAAACGG
GCCGTCGATATGATGAGGCGCGCGGTACCCCGCGCCGCAGGACCCCGGCGGGTC
CTAACTAGGGTATCAAATACCGTGAAGCGTAACGCAGGCGCTCTTAGAGCTCTTC
TGGCTTATCTGCTGTACCAGACATTCTCTGGGCGGAAAGTTGGTAGTGGTGCTCG
GAGCGCCCTTAAGCGCTTCAACAAAAATGACATTGTGAAAATGTTGCTGGCGTTC
AGACGGACATTGACAAACATCATCACAACCATGCAGCGTCGTGTGAAAGGAAAG
AAACGTCGTGGCGTTCAAGATGTGCCGCTATTGGTCTTGCTGCTCGTTGGAGCAG
GAGCGATGGCTGCGGAGGTCACTAGACGTGGGAGTGCATACTATATGTACTTGGA
CAGAAACGATGCTGGGGAGGCCATATCTTTTCCAACCACATTGGGGATGAATAAG
TGTTATATACAGATCATGGATCTTGGACACATGTGTGATGCCACCATGAGCTATG
AATGCCCTATGCTGGATGAGGGGGTGGAACCAGATGACGTCGATTGTTGGTGCAA
CACGACGTCAACTTGGGTTGTGTACGGAACCTGCCATCACAAAAAGGTGAAGC
ACGGAGATCTAGAAGAGCTGTGACGCTCCCTCCCATTCCACTAGGAAGCTGCAA
ACGCGGTCGCAAACCTGGTTGGAATCAAGAGAATACACAAAGCACTTGATTAGA
GTCGAAAATTGGATATTCAGGAACCCTGGCTTCGCGTTAGCAGCAGCTGCCATCG
CTTGGCTTTTGGGAAGCTCAACGAGCCAAAAAGTCATATACTTGGTCATGATACT
GCTGATTGCCCCGGCATACAGCATCAGGTGCATAGGAGTCAGCAATAGGGACTTT
GTGGAAGGTATGTCAGGTGGGACTTGGGTTGATGTTGTCTTGGAACATGGAGGTT
GTGTCACCGTAATGGCACAGGACAAACCGACTGTCGACATAGAGCTGGTTACAA
CAACAGTCAGCAACATGGCGGAGGTAAGATCCTACTGCTATGAGGCATCAATATC
AGACATGGCTTCGGACAGCCGCTGCCCAACACAAGGTGAAGCCTACCTTGACAA

FIG. 66

```
GCAATCAGACACTCAATATGTCTGCAAAAGAACGTTAGTGGACAGAGGCTGGGG
AAATGGATGTGGACTTTTTGGCAAAGGGAGCCTGGTGACATGCGCTAAGTTTGCA
TGCTCCAAGAAAATGACCGGGAAGAGCATCCAGCCAGAGAATCTGGAGTACCGG
ATAATGCTGTCAGTTCATGGCTCCCAGCACAGTGGGATGATCGTTAATGACACAG
GACATGAAACTGATGAGAATAGAGCGAAGGTTGAGATAACGCCCAATTCACCAA
GAGCCGAAGCCACCCTGGGGGGTTTTGGAAGCCTAGGACTTGATTGTGAACCGA
GGACAGGCCTTGACTTTTCAGATTTGTATTACTTGACTATGAATAACAAGCACTG
GTTGGTCCACAAGGAGTGGTTCCACGACATTCCATTACCTTGGCACGCTGGGGCA
GACACCGGAACTCCACACTGGAACAACAAAGAAGCACTGGTAGAGTTCAAGGAC
GCACATGCCAAAAGGCAAACTGTCGTGGTTCTAGGGAGTCAAGAAGGAGCAGTT
CACACGGCCCTTGCTGGAGCTCTGGAGGCTGAGATGGATGGTGCAAAGGGAAGG
CTGTCCTCTGGCCACTTGAAATGTCGCCTGAAAATGGATAAACTTAGATTGAAGG
GCGTGTCATACTCCTTGTGTACCGCAGCGTTCACATTCACCAAGATCCCGGCTGA
AACACTGCACGGGACAGTCACAGTGGAGGTACAGTACGCAGGGACAGATGGACC
TTGCAAGGTTCCAGCTCAGATGGCGGTGGACATGCAAACTCTGACCCCAGTTGGG
AGGTTGATAACCGCTAACCCCGTAATCACTGAAAGCACTGAGAACTCTAAGATGA
TGCTGGAACTTGATCCACCATTTGGGGACTCTTACATTGTCATAGGAGTCGGGGA
GAAGAAGATCACCCACCACTGGCACAGGAGTGGCAGCACCATTGGAAAAGCATT
TGAAGCCACTGTGAGAGGTGCCAAGAGAATGGCAGTCTTGGGAGACACAGCCTG
GGACTTTGGATCAGTTGGAGGCGCTCTCAACTCATTGGGCAAGGGCATCCATCAA
ATTTTTGGAGCAGCTTTCAAATCATTGTTTGGAGGAATGTCCTGGTTCTCACAAAT
CCTCATTGGAACGTTGCTGATGTGGTTGGGTCTGAACACAAAGAATGGATCTATT
TCCCTTATGTGCTTGGCCTTAGGGGGAGTGTTGATCTTCTTATCCACAGCCGTCTC
TGCTCTATCGGAAATAGGATGCAGTCTGGACATTAGCCGAAAAGAAATGAAGTG
TGGGGACGGAGTCTTCATCTTCAGAGAGGCAGGCATGTGGAAGGATGGGTATGC
GTTCCACCCTTCCGAACCCAAATCTCTGGCCGCGTCAGTTCTCAAGAGTTGGCAG
TCTGGAGTGTGCGGCGTGCGCTCCACGAACAGAATGGAACATGCCATGTGGAAA
CAGATTGAAAATGAATTGAACGGCATTCTAGAAGAGAATGAGGCGCAACTCAGC
GTGGTTGTGCGAGAGTCTAACGGGACCTTCCCGAGAGGAGAGCGCCGCATGCAC
GTGGCCGAACCTCTGCGCTATGGATGGAAGACCTGGGGAAAGACCGCAATTTCG
ACGGTGCCGCTCGCTAAAGAAACGTTTGTGGTAGATGGCAATGATGAAGGAGAA
TGTCCCTCTCAAATGCGTGCTTGGAATTCCTTCCAAGTTGAAGAGTTCGGAACTG
GGCTGGTGAAAACCAAAGTGTTCTTGGACATATCCACTGCTCTCACCGCCCAATG
TGACACCAAAATGCTGGGCGCTGCCATAAAGGGGAATAGGTCTGTTCATGGAGA
TCCAGGTCTCTGGATGGTCTCAGCTGAAATCGATGGGACATGGCAGATAATAGAG
CTCACATTGGCAGAGAGCAGGCGTTGCACATGGCCAGACTCTCACACCGTGTGGG
GTAGGAATGTCCAGGAGAGTGAGTTGATACTGCCACCGTCTTTCGGAGGACCGAT
GACCAACATGAACAAGCGTAAAGGCTACGCGACCCAAGTGGGAGGACCATGGAA
CCATGTTCCACTACGAGTAGTTTTGAAGAGTGTCCGGGAACCACTGTATCTGTTG
AACCAAACTGCACCAGGAGATCGGATTCAGTGCGATCCACAACTGATAGCGGCA
AGATTATAACCGACTGGTGTTGTCGTTCCTGTACAATGCCTCCCCTAACGTACCGA
ACCCCCGATGGATGCTGGTATGCAATGGAAATCAGGCCCAAGAATGTTAAAGAG
GAGAGTCTGATCCGTTCGCATGTGGCGGCAGGTGTGTTTAAAGGCATTGACGACG
TGTCACTGGGGCTGTTAGTAATGATAATTTTCCTGCAGGAAGGTTTGAGAAGAAA
GTTAACTGCAACGTATATCA
```

FIG. 66 cont.

```
TGTGGGCTGCTCTTGTGGTCCTCATTGCAGGAATCCTAGGGGAACTCACAGTGAG
GGATGTGCTCAGGTATCTCATCCTAGTCGGCACTGCATTCGCTGAGAGTAATAAT
GGAGGAGATTTAATACATCTGGCCCTAGTGGCGGTCTTCAAGATTAGGCCGGCAT
TCTTATTTGGATTCTTGTTCAGGAGTCAGTGGTCCCCAGAGAAGGTGTGTTGCTG
GCATCTGGAGCGCTGATGCTGCAGATTGCAAGTGAGTGCTTGCACGCATCGGCGA
TTATGCAGGTTGTCGATTCCTTGAGCATGGGGTGGTTGATGATCAGAGCCATTGC
TGTACCTGGTATGACCTCAAAAGCCATGCCACTGCTGTGTGCCTGCATTCCTGCA
GTTACGAGCCTACTGGCCCACTCAACCAGAGCCGGTATAATCACCATGGCCGGCA
TGTCGCTTATTGCAGGAAGTAAGGGATCATCAGTTAAAAAACACAGTCCATACAT
GCTTGCCCTCGTGGTGGCAGGCCTCGGAGCCCGTCCCATAGGAATGTTGGCGATG
GAAGCCTTCTCTCACCTGAAGGGCCGGAGATCATGGCCGGCTGGTGAGATGATGT
CAGCCGTTGGGCTGACATGTGCGCTAGTGGGAGCTATCAGTGGCGCATCATCTCA
GGACTTCGCCGGACCTCTAGCAGCAGCGGCTCTAATTATTATTGCATATGCCATT
AGTGGACGCTCAGCTGATGTATACCTTGAGAAAGCCGGTGAGATATCCTGGAGTG
AGGACGCTAAAATATCCGGATCAAGCCCGCGCATTGATGTGTGCGTTACCGAAAA
TGGAGATTTCAAATTGCGTCATGAGAGTGAAGCAACCTGGACCCGGAATTGTGTC
TTGGCTGCTTGCTTAGTCGTAGCCGGAGTGCACCCACTGGGGATTCCAGTAGCAG
GGTTGATGTGGTTTGGATATGTGAAATCAAACAAGCGGGGGACTGTGTTGTGGGA
CATTCCCTCACCACAGGCAACATCAGCTCCAACGGTGGAAGATGGATGCTACCGC
GTTATGTCACGTAGACTGCTTGGCAGCACTCAGCTTGGTGTTGGGATCATGCTAG
ACTCTACATTTCACACAATGTGGCACATAACCCGAGGAGCATCTATTGTTAGTGG
TGAAGGGCGTCTTGACCCATATTGGGCTGACGTTAAGGAAGACCTGGTCTGTTAC
GGAGGGCCATGGAAAATCCGCAACACATGGGATGGACTCTCAGAAGTTCAGCTG
ATAGCGGTGGCCCCAAAAGAGAATCCCGTGAACGTCCAAACAATGCCAGGAAAG
TTCATTGTGGCGAATGGAGGTGAGATAGGAGCCGTTGTGCTCGACTATCCTCCTG
GAACTTCTGGTTCACCCATCGTGGATCAGCAGGGTAATGTCATAGGACTGTATGG
CAACGGGGTTATGATCAATGACCAAACGTATGCGAGTGCCATTGCGCAAGCTCCA
GCTGAAGTTGCGCGCACCCCAACCTGGTTCACTGATGATATGTTGCGAAAGGGAC
AATTGCATGTGCTAGACTTGCACCCTGGAGCGGGAAAAACCCGCAAGGTCCTGCC
TGAGATTCTCAAAGCAGCGGTGGAGAAACGGCTACGCACGTTGGTCCTGGCCCCA
ACCAGAGTTGTGGCAAAGGAAATGCATGAAGCATTGACCGGGCTGCCGGTACGC
TACCAGACATCAGCAGTGGCACCAAATGGTTCTGGAGGAGAATTGATTGATGTCA
TGTGCCATGCAACATACACACACCGCCAGCTGACACCGGGACGGGGGGTCAACT
ACCAGTTATACATAGTGGATGAGGCACATTTTACAGATCCCGCTTCCATCGCAGC
TCGCGGCATCATTGCGACTAGGGTGCGATTGGGACATGCCGCAGCAATCTTCATG
ACGGCCACACCCCGGGAATGTCAAACCCATTCCCGGAGTCTAATGCTCACATTG
AAGACGAAGAGCGGGAGGTACCCACCAAAGCTTGGAACGCTGGATATGAGTGGA
TAACAGACTATGGGGGAAAAACCGTGTGGTTCGTGCCTTCCATCCGGATGGCGAA
CACCATAGCTGCATGCTTGGTACGAGCAGGCAAGACAGTCATTGTACTGCACAGT
GGCTCTTTCAATGAAGAATATCAAAAAACCAAGTCTGGCAATTGGGATTTCGTTG
TGACGACCGACATCTCAGAAATGGGGGCCAATTTCAAAGCCTCTAGGGTCATAGA
CTCTAGACTGTCCATAAAACCGATGTTTTCCTACGCTCCCAGTGAGCGAGTGGTT
ATTGGCTCACCTAGAGCGGTTTCTCCAGCCAGCGCAGCACAGCGCCGAGGGAGA
GTCGGGAGAGACCCTCGTCAACTGGGCGACCAGTATATCTATGGTGGACCAGTAG
GAGAAGACTCGGCCGAGTTCGTTCATTGGAAGGAAGCAAGGATCCTCATGGATA
ATGTAACTGTCCCTGGGGGCTTGTATCCACAATTCTACGAACCAGAGGGTGGAAT
GTGTGACGCCATGGATGGAGCTCACCGACTGACCGATGCTAAGAGAGAAGTGTT
CCGAGACCTCATGAAGAAAGGGGAACTTCCTGTATGGTTAGCATACCAGGTGGCC
CAGGCTGGGCATGCGTACACTGACAGAACTTGGTGCTATGGGGGGCCGGCGGAT
CATCAAGTGTATGATGATTGCGGCCAAACCGTGGATTACAGGTCCCTTAATGGAG
```

FIG. 66 cont.

AGAGGCGTATGCTACGTCCCAAGTGGCTTGATCAGCGCACCTACAACGACAAAA
CATCCTTAAGGCTCTTCACGGAATTTGCAGAGGGACGCCGCCGATATTCGGAACT
AATGGACGTGTTTGGAAGAATGCCCCAACACATGTTGGACAGGACCATCTTGGCT
GCAGACACGTTTAAAGATGTCCTGACAGCAACACCGGGATCTCGTGTGCACCGTT
TAGCACTGGACAATTTACCCGAAGCTACAGAAACTATGATGGTAGTGGGAATCCT
GAGTGTCTCGACCCTAGGCGTTATGCTATTTCTGATGTCACCCAAGGGCATGACC
CGGATGACCTGCGGACTTGTGGTGATCATCCTGGCGACGTATTTTCTATGGGTGTC
AGGAATGGCCGGCTACCAGATAGCAGCAATGCAACTCATCGCGTTCATTCTGTTT
GTGGTCTTGGTGCCAGAGCCAGGGTCACAGAGATCAGTGCAAGACAACACCATA
GCGATAATTCTCATAGTCATCCTGTCGTTGGCTGCCATCATAGCCGCCAATGAAG
CAGGATTGCTAGAGAAGACCAAAAAGGATTTCGCGTGGAAGAGGGAGAGTCATG
TGCTGGTGACTCCGAGTCCGTGGAACCTGGATTTCTCAATGGATTTGAGGCCAGC
CACCAGCTGGTCATTGTATGTGGTGATGGCCACCATGTTAGGGCCAGTACTGGAA
CACGCCATTGTCACCAATTATGCTAGCGTCTCACTTACTGCCATCACAAACCAGG
CAGGAATACTGCTGTCAATGGATAAGGGCACTCCTTTCTGGAATCTTGACTGGAG
TGTTGTCCTGTTGTGCGTGGGCAGCTGGTCGGGGATCAATGGCACTACACTAATG
GTTGCTTCCACAATGACAGTTTTGCATTTTGCCATGATACTACCTGGCATTCGTGC
CAAAGCGGCGAGAGAAGCACAGAATCGAACAGCAGCTGGGGTGTCAAAGAACC
CTCTTATTGATGGGTTAAACACCATAAACATCCAGCCGTTGCCGGAAATGGACCC
CATGTACGAAAGGAAAATGGGGCTATGGATGCTAATCGCTGTTGCCGGAGCCGC
GGTGGTTTTTGACAAGAGAATGCTCCATTACACCGAGTTCGGAGTATTGGGTTCA
GCTGCTGTGAGTCCTCTCATTGAAGGATACGCGTCTGCTGTTTGGAACACTTCCGT
AGCAGCCAGTGTGTGCAACCTAATGCGAGGCCATTACATGGCGGGAATCCCAAT
GGCATACTCTCTGATCAGAAATCTATCCATGAAAGGAGTTCCTAGGAGGGGATTA
CAGGCCACCCATACCCTTGGTATGGTTTGGAAACACAAATTAAACGCCATGGACA
AGGCGGCCTTTAACGCATACCGGAAGGATGGAGTGACAGAAGTGGATAGGGAGC
CAGCACGTGAAGCTATGAAGAAAGGAGATTTGGTGAGCGGATGGGCGGTCTCTC
GAGGGTCAGCCAAGCTGCGATGGATGCACGAGCGTGGATACATTCCCCTACAAG
GAGTTGTCATTGACCTCGGATGTGGAAGAGGGGGGTGGAGTTACTACGCTGCTGC
ACAACGCCGGGTGACCGCTGTCAAAGGGCTCACGAAAGGCGGACCAGGGCATGA
GGAGCCAATCAACGTCCAGTCATATGGATGGAACTTAGTGACGTTCCGTAGTGGA
GTGGATGTCTTTCACACCGAAGTCCAGCCGGCTGACACCCTGTTGTGCGACATAG
GAGAGTCTTCTGCTGACCCCGCTGTCGAAAAAGCGCGCACAGTACAAGTGTTGGT
GAACTTTGAAAGATGGATTAGAGAGTCGCGGTGTGAGCATTTTGTTGCAAGGTG
CTTGGTCCCTACTCTCCCGAAGTGATGGAGCGCTTAGATCGTTTAACAAAGACAT
ATGGAGGAGCGGTAATTCGCAACCCACTATCCAGGAACTCCACGCATGAGATGT
ACTGGGTGTCAGGAGCTAAGGGTAATCCAGTCAATGCTATAACAGCCACCTCACG
TGTGCTAATCGAACGCATGTACAGAAGACTTGGCAAGAGTTACTGGGAAGAAGA
TGTGAATCTTGGTACTGGGACCCGTGCAGTTTCATGTGCCGCGGAGAAGCCAGAT
CTAGCAAAAATCGGAAGGCGCATTGAGTTGCTGAAGAAGGAGTATAAAGCATCA
TGGTTCGAGGATCCAGAGCATCCCTACAAGACATGGACATACCATGGTTCCTACG
AAACCAAGACCACAGGCAGCTCGTCTAGTATGATTAATGGCGTTGTCAAGGAGAT
CACTCACCCTTGGGATACCAACCCAAGGGTTACAACCGTCTGTATGACCGACACC
ACTCCTTTTGGACAGCAGAGAGTATTCAAGGAAAAGGTAGATACCAAGGCACGT
GAGCCATCTCAAGGGACGCGGGAGATCATGAGAATAGTGAGCAAGTGGCTCACA
CTATATATTGGTCGGAGCAAGCGCCCTAGGCTGTGCACAGCGGATGAATTCATAG
CCAAAGTTAATGCTGATGCCGCTC

FIG. 66 cont.

TCGGCACGATGTTCGACTCGCAGGGAAACTGGGCGAACGCCAAAGAAGCTGTGC
GCGACCCACGGTTTTGGCAGTTGGTGGCCAAAGAGAGGGAACTTCACCTGCGTGG
ACAGTGTGCCACGTGTGTTTACAACATGATGGGGAAGCGAGAGAAAAAGCTGAC
AGAGTTTGGGAAGTCGAAGGGGAGCCGAGCAATTTGGTTTATGTGGCTAGGAGC
TAGGTTCTTGGAGTTTGAAAGTTTAGGCTTCCTAAACGAGGATCATTGGTTGTCAC
GTGAAAACTCAGGAGGTGGAGTTGAGGGCATTGGATTGCAATACCTTGGGTATGT
GTTGAAAGAAATGGCACTAATTCCCGGGGGCAAGATGTACGCCGATGACACCGC
TGGGTGGGACACCAGAATTACTAACGCTGACCTTGAGGATGAGATGGACATATTG
GGACTTATGGACCCGCATCACAAAAAACTGGCAAAAAATCTGATGGAGTTGGCG
TACAACAACAAGGTGGTCAGAGTGATGCGCCCTGGTAAAGGGGGAAAAACACTA
ATGGACATCATTAGCCGCAAGGACCAGCGGGGAAGTGGACAAGTGGTCACCTAC
CCACTCAACACGTGGACGAATCTCAAGGTCCAATTGATCCGTATGGCAGAGTCAG
AGGGAGTGTTGGACCCCAAGGAGATCGATGGAATCACTGTCACGACTCGGAATA
ACCTGGAAAAATGGCTCACTAGCCAAGGGGCTGAGCGTCTAAAGCGCATTGCAG
CTAGCGGTGACGACGTTGTGGTAAAACCAGTGGATGAGAGATTCGCCAATGCTCT
CACCTATCTAAACGACATGGCCAAAATTAGGAAGGACATCAGTGAGTGGAAACC
ATCCGCGGGGTGGTTCCACTGGGAAGAAGTGCCATTCTGCTCACACCATTTTCAC
CAGTTGGTCCTCAAGGATGGGCGCACCTTAGTGGTCCCATGCCGTGACCAGGATG
AACTAATTGGAAGGGCAAGAGTGTCACCTGGTGCTGGATGGACTATCAGAGAAA
CTGCAGGTCTAAGCAAGGCCTATGCCCAGATGTGGCTTCTAATGCACTTCCACCG
GAGGGACCTCAGAATGGCAGGTTTCGCCATTTGTAGTGCTGTCCCCAGTGATTGG
GTGCCCACGGGAAGGACATCGTGGTCACTGCACGCTAAAGGGGAGTGGATGACC
ACTGAAGACATGTTAGCAGTTTGGAACAGAGTGTGGATTGAAGACAATCCCCAC
ATGTCTAACAAGACTTTAGTGGGATCATGGCAAGACATCCCGTACCAGAGGAAAT
CCCTGGACATCCACTGTGGCTCAATGATAGGGCAGCGGTCTAGGTCAACATGGGC
TGCTAACATACGAATTAGCATTGGACACGTGCGCCGATTGATTGGAACCACGGAA
AAGTACTTGGATTACATGCAGGAGCAGGAGCGGTTCAAGATTGCTGAACCAACC
CGTCTGGGCAATGTGATCTAA

FIG. 66 cont.

>SEQ ID NO:391          BinJV/ZIKV-prME ORF aa sequence

MVTKLRRPVKRAVDMMRRAVPRAAGPRRVLTRVSNTVKRNAGALRALLAYLLYQTFSGRKVGSGARSALKRFNKND
IVKMLLAFRRTLTNIITTMQRRVKGKKRRGVQDVPLLVLLLVGAGAMAAEVTRRGSAYYMYLDRNDAGEAISFPTTLG
MNKCYIQIMDLGHMCDATMSYECPMLDEGVEPDDVDCWCNTTSTWVVYGTCHHKKGEARRSRRAVTLPSHSTRKLQ
TRSQTWLESREYTKHLIRVENWIFRNPGFALAAAAIAWLLGSSTSQKVIYLVMILLIAPAYSIRCIGVSNRDFVEGMSGGT
WVDVVLEHGGCVTVMAQDKPTVDIELVTTTVSNMAEVRSYCYEASISDMASDSRCPTQGEAYLDKQSDTQYVCKRTL
VDRGWGNGCGLFGKGSLVTCAKFACSKKMTGKSIQPENLEYRIMLSVHGSQHSGMIVNDTGHETDENRAKVEITPNSP
RAEATLGGFGSLGLDCEPRTGLDFSDLYYLTMNNKHWLVHKEWFHDIPLPWHAGADTGTPHWNNKEALVEFKDAHA
KRQTVVVLGSQEGAVHTALAGALEAEMDGAKGRLSSGHLKCRLKMDKLRLKGVSYSLCTAAFTFTKIPAETLHGTVT
VEVQYAGTDGPCKVPAQMAVDMQTLTPVGRLITANPVITESTENSKMMLELDPPFGDSYIVIGVGEKKITHHWHRSGST
IGKAFEATVRGAKRMAVLGDTAWDFGSVGGALNSLGKGIHQIFGAAFKSLFGGMSWFSQILIGTLLMWLGLNTKNGSI
SLMCLALGGVLIFLSTAVSALSEIGCSLDISRKEMKCGDGVFIFREAGMWKDGYAFHPSEPKSLAASVLKSWQSGVCGV
RSTNRMEHAMWKQIENELNGILEENEAQLSVVVRESNGTFPRGERRMHVAEPLRYGWKTWGKTAISTVPLAKETFVV
DGNDEGECPSQMRAWNSFQVEEFGTGLVKTKVFLDISTALTAQCDTKMLGAAIKGNRSVHGDPGLWMVSAEIDGTWQ
IIELTLAESRRCTWPDSHTVWGRNVQESELILPPSFGGPMTNMNKRKGYATQVGGPWNHVPLRVVFEECPGTTVSVEPN
CTRRSDSVRSTTDSGKIITDWCCRSCTMPPLTYRTPDGCWYAMEIRPKNVKEESLIRSHVAAGVFKGIDDVSLGLLVMII
FLQEGLRRKLTATYIMWAALVVLIAGILGELTVRDVLRYLILVGTAFAESNNGGDLIHLALVAVFKIRPAFLFGFLFRSQ
WSPREGVLLASGALMLQIASECLHASAIMQVVDSLSMGWLMIRAIAVPGMTSKAMPLLCACIPAVTSLLAHSTRAGIIT
MAGMSLIAGSKGSSVKKHSPYMLALVVAGLGARPIGMLAMEAFSHLKGRRSWPAGEMMSAVGLTCALVGAISGASSQ
DFAGPLAAAALIIIAYAISGRSADVYLEKAGEISWSEDAKISGSSPRIDVCVTENGDFKLRHESEATWTRNCVLAACLVV
AGVHPLGIPVAGLMWFGYVKSNKRGTVLWDIPSPQATSAPTVEDGCYRVMSRRLLGSTQLGVGIMLDSTFHTMWHITR
GASIVSGEGRLDPYWADVKEDLVCYGGPWKIRNTWDGLSEVQLIAVAPKENPVNVQTMPGKFIVANGGEIGAVVLDY
PPGTSGSPIVDQQGNVIGLYGNGVMINDQTYASAIAQAPAEVARTPTWFTDDMLRKGQLHVLDLHPGAGKTRKVLPEI
LKAAVEKRLRTLVLAPTRVVAKEMHEALTGLPVRYQTSAVAPNGSGGELIDVMCHATYTHRQLTPGRGVNYQLYIVD
EAHFTDPASIAARGIIATRVRLGHAAAIFMTATPPGMSNPFPESNAHIEDEEREVPTKAWNAGYEWITDYGGKTVWFVP
SIRMANTIAACLVRAGKTVIVLHSGSFNEEYQKTKSGNWDFVVTTDISEMGANFKASRVIDSRLSIKPMFSYAPSERVVI
GSPRAVSPASAAQRRGRVGRDPRQLGDQYIYGGPVGEDSAEFVHWKEARILMDNVTVPGGLYPQFYEPEGGMCDAMD
GAHRLTDAKREVFRDLMKKGELPVWLAYQVAQAGHAYTDRTWCYGGPADHQVYDDCGQTVDYRSLNGERRMLRP
KWLDQRTYNDKTSLRLFTEFAEGRRRYSELMDVFGRMPQHMLDRTILAADTFKDVLTATPGSRVHRLALDNLPEATET
MMVVGILSVSTLGVMLFLMSPKGMTRMTCGLVVIILATYFLWVSGMAGYQIAAMQLIAFILFVVLVPEPGSQRSVQDN
TIAIILIVILSLAAIIAANEAGLLEKTKKDFAWKRESHVLVTPSPWNLDFSMDLRPATSWSLYVVMATMLGPVLEHAIVT
NYASVSLTAITNQAGILLSMDKGTPFWNLDWSVVLLCVGSWSGINGTTLMVASTMTVLHFAMILPGIRAKAAREAQNR
TAAGVSKNPLIDGLNTINIQPLPEMDPMYERKMGLWMLIAVAGAAVVFDKRMLHYTEFGVLGSAAVSPLIEGYASAV
WNTSVAASVCNLMRGHYMAGIPMAYSLIRNLSMKGVPRRGLQATHTLGMVWKHKLNAMDKAAFNAYRKDGVTEV
DREPAREAMKKGDLVSGWAVSRGSAKLRWMHERGYIPLQGVVIDLGCGRGGWSYYAAAQRRVTAVKGLTKGGPGH
EEPINVQSYGWNLVTFRSGVDVFHTEVQPADTLLCDIGESSADPAVEKARTVQVLVNFERWIRESRCEHFCCKVLGPYS
PEVMERLDRLTKTYGGAVIRNPLSRNSTHEMYWVSGAKGNPVNAITATSRVLIERMYRRLGKSYWEEDVNLGTGTRA
VSCAAEKPDLAKIGRRIELLKKEYKASWFEDPEHPYKTWTYHGSYETKTTGSSSSMINGVVKEITHPWDTNPRVTTVCM
TDTTPFGQQRVFKEKVDTKAREPSQGTREIMRIVSKWLTLYIGRSKRPRLCTADEFIAKVNADAALGTMFDSQGNWAN
AKEAVRDPRFWQLVAKERELHLRGQCATCVYNMMGKREKKLTEFGKSKGSRAIWFMWLGARFLEFESLGFLNEDHW
LSRENSGGGVEGIGLQYLGYVLKEMALIPGGKMYADDTAGWDTRITNADLEDEMDILGLMDPHHKKLAKNLMELAY
NNKVVRVMRPGKGGKTLMDIISRKDQRGSGQVVTYPLNTWTNLKVQLIRMAESEGVLDPKEIDGITVTTRNNLEKWLT
SQGAERLKRIAASGDDVVVKPVDERFANALTYLNDMAKIRKDISEWKPSAGWFHWEEVPFCSHHFHQLVLKDGRTLV
VPCRDQDELIGRARVSPGAGWTIRETAGLSKAYAQMWLLMHFHRRDLRMAGFAICSAVPSDWVPTGRTSWSLHAKGE
WMTTEDMLAVWNRVWIEDNPHMSNKTLVGSWQDIPYQRKSLDIHCGSMIGQRSRSTWAANIRISIGHVRRLIGTTEKY
LDYMQEQERFKIAEPTRLGNV

FIG. 67

>SEQ ID NO:392      BinJV-WNVED1 chimeric ISF vector
GGGTCGGCATGGCATCTCCACCTCCTCGCGGTCCGACCTGGGCATCCGAAGGAGG
ACGTCGTCCACTCGGATGGCTAAGGGAGAGCCACTTTTCTCTCGATTCTCTATCGG
AATCTAGGGAGCTCGGATCCAGACATGATAAGATACATTGATGAGTTTGGACAA
ACCACAACTAGAATGCAGTGAAAAAAATGCTTTATTTGTGAAATTTGTGATGCTA
TTGCTTTATTTGTAACCATTATAAGCTGCAATAAACAAGTTAACAACAACAATTG
CTCGAGGGGGGGCCCGGTACCTTGAAGCTGTCCCTGATGGTCGTCATCTACCTGC
CTGGACAGCATGGCCTGCAACGCGGGCATCCCGATGCCGCCGGAAGCGAGAAGA
ATCATAATGGGGAAGGCCATCCAGCCTCGCGTCGGCGCTTAAGGATCATGATGAT
AAACAATGTATGGTGCTAATGTTGCTTCAACAACAATTCTGTTGAACTGTGTTTTC
ATGTTTGCCAACAAGCACCTTTATACTCGGTGGCCTCCCCACCACCAACTTTTTG
CACTGCAAAAAAACACGCTTTTGCACGCGGGCCCATACATAGTACAAACTCTACG
TTTCGTAGACTATTTTACATAAATAGTCTACACCGTTGTATACGCTCCAAATACAC
TACCACACATTGAACCTTTTTGCAGTGCAAAAAAGTACGTGTCGGCAGTCACGTA
GGCCGGCCTTATCGGGTCGCGTCCTGTCACGTACGAATCACATTATCGGACCGGA
CGAGTGTTGTCTTATCGTGACAGGACGCCAGCTTCCTGTGTTGCTAACCGCAGCC
GGACGCAACTCCTTATCGGAACAGGACGCGCCTCCATATCAGCCGCGCGTTATCT
CATGCGCGTGACCGGACACGAGGCGCCCGTCCCGCTTATCGCGCCTATAAATACA
GCCCGCAACGATCTGGTAAACAGTATATTTTGCGTGTGCGTTTCAAAACACAGAT
TGTATTGAAAGTACGTAAGAGTATAACACGTTGGAATAAAGTTTTGGATCAAGAG
GAAAATCATGGTTACAAAACTCAGGAGGCCCGTTAAACGGGCCGTCGATATGAT
GAGGCGCGCGGTACCCCGCCGCGCAGGACCCCGGCGGGTCCTAACTAGGGTATC
AAATACCGTGAAGCGTAACGCAGGCGCTCTTAGAGCTCTTCTGGCTTATCTGCTG
TACCAGACATTCTCTGGGCGGAAAGTTGGTAGTGGTGCTCGGAGCGCCCTTAAGC
GCTTCAACAAAAATGACATTGTGAAAATGTTGCTGGCGTTCAGACGGACATTGAC
AAACATCATCACAACCATGCAGCGTCGTGTGAAAGGAAAGAAACGTCGTGGCGT
TCAAGATGTGCCGCTATTGGTCTTGCTGCTCGTTGGAGCAGGAGCGATGGCTGCC
ACTTTACGCACCGTTGGAGACTTGACATGGCTAAATGTGTCAACCACTGATGTTG
GAAAGTGGATACGTGTGGAGAATAGGCACGGCAAAGGAGAGTGTTTCGTCACGG
CCACTGACGTTGGAACATGGTGCTCAGACTCTGTGGGATATGAATGTCCTCAAAT
TGCACCGGCGTATGACCCTGAAGACTTGGATTGCTACTGCCGAAACACCTCAACC
TACGTTACTTATGGAAGGTGTAAAAATGGGCGCAGTGGACGATCTCGCAGCAAG
AGAGCAATCACGATAGCCCCGCACGGCGAAGCAGGATTGCGTGTTGGAAGCACC
AAGCATTGGACTTCTAGAGCAACTCCACAACGGTATCTAATGCGCGTTGAGAAAT
GGGTGCTGCGGCATCCTCTACCTGCTCTCGTGTTGGTGGTACTGGGATGGATGAT
GGGTCGTTCTCACGGCCAGAGGGCCATGTATATAGTGCTGATGCTGCTTGTGGCT
CCGTCATATGGTAACCAATGCCTGGATGTGCAGTCACGTGATTTCGTGCAAGGGG
TTAGTGGTGGCACCTGGGTAGATGTTGTTTGGATCATGACAATTGCATAACCATT
GTTGCTGACGGGAAACCATCTTTTGATATTCGTTTGTCGAAAATGAGCATGTCTA
AATTCGCAGAGTACAAACGGTATTGCCTCCAGGCCACGATGAGTGATGTCACTAG
CATAGTGGCGTGTCCAGGGGCTGGGGATGCTCATAATGACAAGAGCAAAAACCA
CGAGTACATTTGCAAAGCTGTTAACAATGACCGCGGATGGGGCAATGGGTGTGTC
CTTTTTGGCAAAGGATCAATGGAAACTTGTGGTAAGTTTGAATGTAAGAAGAAA
TGGCTGGCAAGTTAGTGGCACGTGAGAACGTGGAATCAGTGGTCACTGTGCATGT
ACATGGTGCCACTACTGTGGAGTCGCACGGAAACTACTCCACACAGGTTGGAGCC
ACTCAGGCAGGGAAAGCGACTATCACGCCAAAAGCTTCTGTGGCTACTCTAAATT
TAAACGACTTTGGTAGCCTGGAGGTGGATTGTTCAACTGATGTTGGCATGGACTT
TGGAGAGATTGTGGTGGCCGACATGTCAGGAAAGTGGTGGATCGTGAACAAGGA

FIG. 68

```
TTGGTTCAATGAACTTGCTTTGCCGTGGTCCACGGCTAGCACCACTGCTGAAGTTT
GGCAGGCACGAGACAGACTTGTTGAGTTTGGATGGCCACATGCGGCCAAGCAGA
ACATCTATGACATTGGGGACCAAGAAGGAGCTGTGACGGCTGCCATAGCCCAGG
CACCCATGGCGAAATGGGAGTCTGACAAGGTCGAGCTAATCTCTGGGATTCTCAA
GTGCAAGGTGAAACTTGGCAACCTAAAGCTGCGTGGGGTGACCTATAGCATGTGT
GCCCAGACATTCACCACGGAAACAAGGCCGGCCGACACCGGACATGGCACTGTG
GCTTTCAAGGTGAAATACGTCGGAACAGACGTGCCTTGCCGGGTCCCACTCCACA
TCATAGACAGTGACGGCGGAGTGGCCGCTGGACGAGTGATAACGGCACACCCCT
TCGTCATGAAGCAGAATGATTACATTATTCTGGAAGTTGAACCACCCTTCGGTGA
CAGCAAAATTGAGATTGGAACAGGAACAACAAAACTCGTTGAAGCATGGCATCG
AAAAGGTAGCTCGATAGGAAATGCCTTTACGGCCACTTACAAGGGCATCACAAA
ATTGACAGTGCTTGGAGAACATGCCTGGGATTTTAATTCACTAGGTGGGTTTGGA
GCAAGCCTTGGGAAGGCGGTCCATACACTGTTTGGAGGTGTATTCCGGGTGATGT
TCGGAGGCATGGGATGGTTAACCAAGATCTTTGTGGGTGCTGTCCTAGTCTGGCT
AGGATTAGGAGCTCATGACAAGACGATCGCCACCACCATGATCCTGGTAGGATCC
ATACTGATGTACATGGCAGTGACCGTGGGTGCCCTATCGGAAATAGGATGCAGTC
TGGACATTAGCCGAAAAGAAATGAAGTGTGGGGACGGAGTCTTCATCTTCAGAG
AGGCAGGCATGTGGAAGGATGGGTATGCGTTCCACCCTTCCGAACCCAAATCTCT
GGCCGCGTCAGTTCTCAAGAGTTGGCAGTCTGGAGTGTGCGGCGTGCGCTCCACG
AACAGAATGGAACATGCCATGTGGAAACAGATTGAAAATGAATTGAACGGCATT
CTAGAAGAGAATGAGGCGCAACTCAGCGTGGTTGTGCGAGAGTCTAACGGGACC
TTCCCGAGAGGAGAGCGCCGCATGCACGTGGCCGAACCTCTGCGCTATGGATGG
AAGACCTGGGGAAAGACCGCAATTTCGACGGTGCCGCTCGCTAAAGAAACGTTT
GTGGTAGATGGCAATGATGAAGGAGAATGTCCCTCTCAAATGCGTGCTTGGAATT
CCTTCCAAGTTGAAGAGTTCGGAACTGGGCTGGTGAAAACCAAAGTGTTCTTGGA
CATATCCACTGCTCTCACCGCCCAATGTGACACCAAAATGCTGGGCGCTGCCATA
AAGGGGAATAGGTCTGTTCATGGAGATCCAGGTCTCTGGATGGTCTCAGCTGAAA
TCGATGGGACATGGCAGATAATAGAGCTCACATTGGCAGAGAGCAGGCGTTGCA
CATGGCCAGACTCTCACACCGTGTGGGGTAGGAATGTCCAGGAGAGTGAGTTGAT
ACTGCCACCGTCTTTCGGAGGACCGATGACCAACATGAACAAGCGTAAAGGCTA
CGCGACCCAAGTGGGAGGACCATGGAACCATGTTCCACTACGAGTAGTTTTTGAA
GAGTGTCCGGGAACCACTGTATCTGTTGAACCAAACTGCACCAGGAGATCGGATT
CAGTGCGATCCACAACTGATAGCGGCAAGATTATAACCGACTGGTGTTGTCGTTC
CTGTACAATGCCTCCCCTAACGTACCGAACCCCCGATGGATGCTGGTATGCAATG
GAAATCAGGCCCAAGAATGTTAAAGAGGAGAGTCTGATCCGTTCGCATGTGGCG
GCAGGTGTGTTTAAAGGCATTGACGACGTGTCACTGGGGCTGTTAGTAATGATAA
TTTTCCTGCAGGAAGGTTTGAGAAGAAAGTTAACTGCAACGTATATCATGTGGGC
TGCTCTTGTGGTCCTCATTGCAGGAATCCTAGGGGAACTCACAGTGAGGGATGTG
CTCAGGTATCTCATCCTAGTCGGCACTGCATTCGCTGAGAGTAATAATGGAGGAG
ATTTAATACATCTGGCCCTAGTGGCGGTCTTCAAGATTAGGCCGGCATTCTTATTT
GGATTCTTGTTCAGGAGTCAGTGGTCCCCAGAGAAGGTGTGTTGCTGGCATCTG
GAGCGCTGATGCTGCAGATTGCAAGTGAGTGCTTGCACGCATCGGCGATTATGCA
GGTTGTCGATTCCTTGAGCATGGGGTGGTTGATGATCAGAGCCATTGCTGTACCT
GGTATGACCTCAAAAGCCATGCCACTGCTGTGTGCCTGCATTCCTGCAGTTACGA
GCCTACTGGCCCACTCAACCAGAGCCGGTATAATCACCATGGCCGGCATGTCGCT
TATTGCAGGAAGTAAGGGATCATCAGTTAAAAAACACAGTCCATACATGCTTGCC
CTCGTGGTGGCAGGCCTCGGAGCCCGTCCCATAGGAATGTT
```

FIG. 68 cont.

```
GGCGATGGAAGCCTTCTCTCACCTGAAGGGCCGGAGATCATGGCCGGCTGGTGA
GATGATGTCAGCCGTTGGGCTGACATGTGCGCTAGTGGGAGCTATCAGTGGCGCA
TCATCTCAGGACTTCGCCGGACCTCTAGCAGCAGCGGCTCTAATTATTATTGCATA
TGCCATTAGTGGACGCTCAGCTGATGTATACCTTGAGAAAGCCGGTGAGATATCC
TGGAGTGAGGACGCTAAAATATCCGGATCAAGCCCGCGCATTGATGTGTGCGTTA
CCGAAAATGGAGATTTCAAATTGCGTCATGAGAGTGAAGCAACCTGGACCCGGA
ATTGTGTCTTGGCTGCTTGCTTAGTCGTAGCCGGAGTGCACCCACTGGGGATTCCA
GTAGCAGGGTTGATGTGGTTTGGATATGTGAAATCAAACAAGCGGGGGACTGTGT
TGTGGGACATTCCCTCACCACAGGCAACATCAGCTCCAACGGTGGAAGATGGATG
CTACCGCGTTATGTCACGTAGACTGCTTGGCAGCACTCAGCTTGGTGTTGGGATC
ATGCTAGACTCTACATTTCACACAATGTGGCACATAACCCGAGGAGCATCTATTG
TTAGTGGTGAAGGGCGTCTTGACCCATATTGGGCTGACGTTAAGGAAGACCTGGT
CTGTTACGGAGGGCCATGGAAAATCCGCAACACATGGGATGGACTCTCAGAAGT
TCAGCTGATAGCGGTGGCCCCAAAAGAGAATCCCGTGAACGTCCAAACAATGCC
AGGAAAGTTCATTGTGGCGAATGGAGGTGAGATAGGAGCCGTTGTGCTCGACTAT
CCTCCTGGAACTTCTGGTTCACCCATCGTGGATCAGCAGGGTAATGTCATAGGAC
TGTATGGCAACGGGGTTATGATCAATGACCAAACGTATGCGAGTGCCATTGCGCA
AGCTCCAGCTGAAGTTGCGCGCACCCCAACCTGGTTCACTGATGATATGTTGCGA
AAGGGACAATTGCATGTGCTAGACTTGCACCCTGGAGCGGGAAAAACCCGCAAG
GTCCTGCCTGAGATTCTCAAAGCAGCGGTGGAGAAACGGCTACGCACGTTGGTCC
TGGCCCCAACCAGAGTTGTGGCAAAGGAAATGCATGAAGCATTGACCGGGCTGC
CGGTACGCTACCAGACATCAGCAGTGGCACCAAATGGTTCTGGAGGAGAATTGA
TTGATGTCATGTGCCATGCAACATACACACACCGCCAGCTGACACCGGGACGGGG
GGTCAACTACCAGTTATACATAGTGGATGAGGCACATTTTACAGATCCCGCTTCC
ATCGCAGCTCGCGGCATCATTGCGACTAGGGTGCGATTGGGACATGCCGCAGCAA
TCTTCATGACGGCCACACCCCCGGGAATGTCAAACCCATTCCCGGAGTCTAATGC
TCACATTGAAGACGAAGAGCGGGAGGTACCCACCAAAGCTTGGAACGCTGGATA
TGAGTGGATAACAGACTATGGGGGAAAAACCGTGTGGTTCGTGCCTTCCATCCGG
ATGGCGAACACCATAGCTGCATGCTTGGTACGAGCAGGCAAGACAGTCATTGTAC
TGCACAGTGGCTCTTTCAATGAAGAATATCAAAAAACCAAGTCTGGCAATTGGGA
TTTCGTTGTGACGACCGACATCTCAGAAATGGGGGCCAATTTCAAAGCCTCTAGG
GTCATAGACTCTAGACTGTCCATAAAACCGATGTTTTCCTACGCTCCCAGTGAGC
GAGTGGTTATTGGCTCACCTAGAGCGGTTTCTCCAGCCAGCGCAGCACAGCGCCG
AGGGAGAGTCGGGAGAGACCCTCGTCAACTGGGCGACCAGTATATCTATGGTGG
ACCAGTAGGAGAAGACTCGGCCGAGTTCGTTCATTGGAAGGAAGCAAGGATCCT
CATGGATAATGTAACTGTCCCTGGGGGCTTGTATCCACAATTCTACGAACCAGAG
GGTGGAATGTGTGACGCCATGGATGGAGCTCACCGACTGACCGATGCTAAGAGA
GAAGTGTTCCGAGACCTCATGAAGAAAGGGGAACTTCCTGTATGGTTAGCATACC
AGGTGGCCCAGGCTGGGCATGCGTACACTGACAGAACTTGGTGCTATGGGGGGC
CGGCGGATCATCAAGTGTATGATGATTGCGGCCAAACCGTGGATTACAGGTCCCT
TAATGGAGAGAGGCGTATGCTACGTCCCAAGTGGCTTGATCAGCGCACCTACAAC
GACAAAACATCCTTAAGGCTCTTCACGGAATTTGCAGAGGGACGCCGCCGATATT
CGGAACTAATGGACGTGTTTGGAAGAATGCCCCAACACATGTTGGACAGGACCA
TCTTGGCTGCAGACACGTTTAAAGATGTCCTGACAGCAACACCGGGATCTCGTGT
GCACCGTTTAGCACTGGACAATTTACCCGAAGCTACAGAAACTATGATGGTAGTG
GGAATCCTGAGTGTCTCGACCCTAGGCGTTATGCTATTTCTGATGTCACCCAAGG
GCATGACCCGGATGACCTGCGGACTTGTGGTGATCATCCTGGCGACGTATTTTCT
ATGGGTGTCAGGAATGGCCGGCTACCAGATAGCAGCAATGCAACTCATCGCGTTC
ATTCTGTTTGTGGTCTTGGTGCCAGAGCCAGGGTCACAGAGATCAGTGCAAGACA
ACACCATAGCGATAATTCTCATAGTCATCCTGTCGTTGGCTGCCATCATAGCCGCC
AATGAAGCAGGATTGCTAGAGAAGACCAAAAAGGATTTCGCGTGGAAGAGGGAG
```

FIG. 68 cont.

```
AGTCATGTGCTGGTGACTCCGAGTCCGTGGAACCTGGATTTCTCAATGGATTTGA
GGCCAGCCACCAGCTGGTCATTGTATGTGGTGATGGCCACCATGTTAGGGCCAGT
ACTGGAACACGCCATTGTCACCAATTATGCTAGCGTCTCACTTACTGCCATCACA
AACCAGGCAGGAATACTGCTGTCAATGGATAAGGGCACTCCTTTCTGGAATCTTG
ACTGGAGTGTTGTCCTGTTGTGCGTGGGCAGCTGGTCGGGGATCAATGGCACTAC
ACTAATGGTTGCTTCCACAATGACAGTTTTGCATTTTGCCATGATACTACCTGGCA
TTCGTGCCAAAGCGGCGAGAGAAGCACAGAATCGAACAGCAGCTGGGGTGTCAA
AGAACCCTCTTATTGATGGGTTAAACACCATAAACATCCAGCCGTTGCCGGAAAT
GGACCCCATGTACGAAAGGAAAATGGGGCTATGGATGCTAATCGCTGTTGCCGG
AGCCGCGGTGGTTTTGACAAGAGAATGCTCCATTACACCGAGTTCGGAGTATTG
GGTTCAGCTGCTGTGAGTCCTCTCATTGAAGGATACGCGTCTGCTGTTTGGAACA
CTTCCGTAGCAGCCAGTGTGTGCAACCTAATGCGAGGCCATTACATGGCGGGAAT
CCCAATGGCATACTCTCTGATCAGAAATCTATCCATGAAAGGAGTTCCTAGGAGG
GGATTACAGGCCACCCATACCCTTGGTATGGTTTGGAAACACAAATTAAACGCCA
TGGACAAGGCGGCCTTTAACGCATACCGGAAGGATGGAGTGACAGAAGTGGATA
GGGAGCCAGCACGTGAAGCTATGAAGAAGGAGATTTGGTGAGCGGATGGGCGG
TCTCTCGAGGGTCAGCCAAGCTGCGATGGATGCACGAGCGTGGATACATTCCCCT
ACAAGGAGTTGTCATTGACCTCGGATGTGGAAGAGGGGGGTGGAGTTACTACGC
TGCTGCACAACGCCGGGTGACCGCTGTCAAAGGGCTCACGAAAGGCGGACCAGG
GCATGAGGAGCCAATCAACGTCCAGTCATATGGATGGAACTTAGTGACGTTCCGT
AGTGGAGTGGATGTCTTTCACACCGAAGTCCAGCCGGCTGACACCCTGTTGTGCG
ACATAGGAGAGTCTTCTGCTGACCCCGCTGTCGAAAAAGCGCGCACAGTACAAGT
GTTGGTGAACTTTGAAAGATGGATTAGAGAGTCGCGGTGTGAGCATTTTTGTTGC
AAGGTGCTTGGTCCCTACTCTCCCGAAGTGATGGAGCGCTTAGATCGTTTAACAA
AGACATATGGAGGAGCGGTAATTCGCAACCCACTATCCAGGAACTCCACGCATG
AGATGTACTGGGTGTCAGGAGCTAAGGGTAATCCAGTCAATGCTATAACAGCCAC
CTCACGTGTGCTAATCGAACGCATGTACAGAAGACTTGGCAAGAGTTACTGGGAA
GAAGATGTGAATCTTGGTACTGGGACCCGTGCAGTTTCATGTGCCGCGGAGAAGC
CAGATCTAGCAAAAATCGGAAGGCGCATTGAGTTGCTGAAGAAGGAGTATAAAG
CATCATGGTTCGAGGATCCAGAGCATCCCTACAAGACATGGACATACCATGGTTC
CTACGAAACCAAGACCACAGGCAGCTCGTCTAGTATGATTAATGGCGTTGTCAAG
GAGATCACTCACCCTTGGGATACCAACCCAAGGGTTACAACCGTCTGTATGACCG
ACACCACTCCTTTTGGACAGCAGAGAGTATTCAAGGAAAAGGTAGATACCAAGG
CACGTGAGCCATCTCAAGGGACGCGGGAGATCATGAGAATAGTGAGCAAGTGGC
TCACACTATATATTGGTCGGAGCAAGCGCCCTAGGCTGTGCACAGCGGATGAATT
CATAGCCAAAGTTAATGCTGATGCCGCTCTCGGCACGATGTTCGACTCGCAGGGA
AACTGGGCGAACGCCAAAGAAGCTGTGCGCGACCCACGGTTTTGGCAGTTGGTG
GCCAAAGAGAGGGAACTTCACCTGCGTGGACAGTGTGCCACGTGTGTTTACAACA
TGATGGGGAAGCGAGAGAAAAAGCTGACAGAGTTTGGGAAGTCGAAGGGGAGC
CGAGCAATTTGGTTTATGTGGCTAGGAGCTAGGTTCTTGGAGTTTGAAAGTTTAG
GCTTCCTAAACGAGGATCATTGGTTGTCACGTGAAAACTCAGGAGGTGGAGTTGA
GGGCATTGGATTGCAATACCTTGGGTATGTGTTGAAAGAAATGGCACTAATTCCC
GGGGGCAAGATGTACGCCGATGACACCGCTGGGTGGGACACCAGAATTACTAAC
GCTGACCTTGAGGATGAGATGGACATATTGGGACTTATGGACCCGCATCACAAAA
AACTGGCAAAAAATCTGATGGAGTTGGCGTACAACAACAAGGTGGTCAGAGTGA
TGCGCCCTGGTAAAGGGGGAAAAACACTAATGGACATCATTAGCCGCAAGGACC
AGCGGGGAAGTGGACAAGTGGTCACCTACCCACTCAACACGTGGACGAATCTCA
AGGTCCAATTGATCCGTATGGCAGAGTCAGAGGGAGTGTTGGACCCCAAGGAGA
TCGATGGAATCAC
```

FIG. 68 cont.

```
TGTCACGACTCGGAATAACCTGGAAAAATGGCTCACTAGCCAAGGGGCTGAGCG
TCTAAAGCGCATTGCAGCTAGCGGTGACGACGTTGTGGTAAAACCAGTGGATGA
GAGATTCGCCAATGCTCTCACCTATCTAAACGACATGGCCAAAATTAGGAAGGAC
ATCAGTGAGTGGAAACCATCCGCGGGGTGGTTCCACTGGGAAGAAGTGCCATTCT
GCTCACACCATTTTCACCAGTTGGTCCTCAAGGATGGGCGCACCTTAGTGGTCCC
ATGCCGTGACCAGGATGAACTAATTGGAAGGGCAAGAGTGTCACCTGGTGCTGG
ATGGACTATCAGAGAAACTGCAGGTCTAAGCAAGGCCTATGCCCAGATGTGGCTT
CTAATGCACTTCCACCGGAGGGACCTCAGAATGGCAGGTTTCGCCATTTGTAGTG
CTGTCCCCAGTGATTGGGTGCCCACGGGAAGGACATCGTGGTCACTGCACGCTAA
AGGGGAGTGGATGACCACTGAAGACATGTTAGCAGTTTGGAACAGAGTGTGGAT
TGAAGACAATCCCCACATGTCTAACAAGACTTTAGTGGGATCATGGCAAGACATC
CCGTACCAGAGGAAATCCCTGGACATCCACTGTGGCTCAATGATAGGGCAGCGGT
CTAGGTCAACATGGGCTGCTAACATACGAATTAGCATTGGACACGTGCGCCGATT
GATTGGAACCACGGAAAAGTACTTGGATTACATGCAGGAGCAGGAGCGGTTCAA
GATTGCTGAACCAACCCGTCTGGGCAATGTGATCTAAGGATCTACGAACGAGAAT
AAGTAGAAGAACGGAACGACAGAGTCAGGCCTCAAATGAGCCAGCATTAATGAG
AGTAAGTGCTGCTGCCTGTGCCTCTCCTTAACACGTGGTAGCGCCACTCGTGTTTC
GTTACCTAATAGCGCTAGAGTCAGACCCAAGTAGGCCAGGGCTATGGTTGTAAGC
CCTGCTGTCTGTGGCAGCCATCCAGTGGTAATGCGTCGCACCACTAAGGATTAAT
AGACGTATATTGGGAGGGACTGGTGAGGAGCAGCAAGCTCGAGCTGCATCACCC
ACTGGTACTATCGGTTAGAGGAAACCCCCTCCAAAATGTAGAGCATCATATCGAC
ACCTGGGAAAGACCGGAGATACCTCTTGCTTCACAGCACTCAATCCACAAGGCAC
AGATCGCCGAATAATTGTGGATTGGGGATTGAGAAACATCAAGTATCT
```

FIG. 68 cont.

>SEQ ID NO:393    BinJV-WNVED1 ORF aa sequence

MVTKLRRPVKRAVDMMRRAVPRAAGPRRVLTRVSNTVKRNAGALRALLAYLLYQTFSGRKVGSGARSALKRFNKND
IVKMLLAFRRTLTNIITTMQRRVKGKKRRGVQDVPLLVLLLVGAGAMAATLRTVGDLTWLNVSTTDVGKWIRVENRH
GKGECFVTATDVGTWCSDSVGYECPQIAPAYDPEDLDCYCRNTSTYVTYGRCKNGRSGRSRSKRAITIAPHGEAGLRV
GSTKHWTSRATPQRYLMRVEKWVLRHPLPALVLVVLGWMMGRSHGQRAMYIVLMLLVAPSYGNQCLDVQSRDFVQ
GVSGGTWVDVVLDHDNCITIVADGKPSFDIRLSKMSMSKFAEYKRYCLQATMSDVTSIVACPGAGDAHNDKSKNHEYI
CKAVNNDRGWGNGCVLFGKGSMETCGKFECKKKMAGKLVARENVESVVTVHVHGATTVESHGNYSTQVGATQAGK
ATITPKASVATLNLNDFGSLEVDCSTDVGMDFGEIVVADMSGKWWIVNKDWFNELALPWSTASTTAEVWQARDRLVE
FGWPHAAKQNIYDIGDQEGAVTAAIAQAPMAKWESDKVELISGILKCKVKLGNLKLRGVTYSMCAQTFTTETRPADTG
HGTVAFKVKYVGTDVPCRVPLHIIDSDGGVAAGRVITAHPFVMKQNDYIILEVEPPFGDSKIEIGTGTTKLVEAWHRKGS
SIGNAFTATYKGITKLTVLGEHAWDFNSLGGFGASLGKAVHTLFGGVFRVMFGGMGWLTKIFVGAVLVWLGLGAHDK
TIATTMILVGSILMYMAVTVGALSEIGCSLDISRKEMKCGDGVFIFREAGMWKDGYAFHPSEPKSLAASVLKSWQSGVC
GVRSTNRMEHAMWKQIENELNGILEENEAQLSVVVRESNGTFPRGERRMHVAEPLRYGWKTWGKTAISTVPLAKETF
VVDGNDEGECPSQMRAWNSFQVEEFGTGLVKTKVFLDISTALTAQCDTKMLGAAIKGNRSVHGDPGLWMVSAEIDGT
WQIIELTLAESRRCTWPDSHTVWGRNVQESELILPPSFGGPMTNMNKRKGYATQVGGPWNHVPLRVVFEECPGTTVSV
EPNCTRRSDSVRSTTDSGKIITDWCCRSCTMPPLTYRTPDGCWYAMEIRPKNVKEESLIRSHVAAGVFKGIDDVSLGLLV
MIIFLQEGLRRKLTATYIMWAALVVLIAGILGELTVRDVLRYLILVGTAFAESNNGGDLIHLALVAVFKIRPAFLFGFLFR
SQWSPREGVLLASGALMLQIASECLHASAIMQVVDSLSMGWLMIRAIAVPGMTSKAMPLLCACIPAVTSLLAHSTRAGI
ITMAGMSLIAGSKGSSVKKHSPYMLALVVAGLGARPIGMLAMEAFSHLKGRRSWPAGEMMSAVGLTCALVGAISGAS
SQDFAGPLAAAALIIIAYAISGRSADVYLEKAGEISWSEDAKISGSSPRIDVCVTENGDFKLRHESEATWTRNCVLAACL
VVAGVHPLGIPVAGLMWFGYVKSNKRGTVLWDIPSPQATSAPTVEDGCYRVMSRRLLGSTQLGVGIMLDSTFHTMWH
ITRGASIVSGEGRLDPYWADVKEDLVCYGGPWKIRNTWDGLSEVQLIAVAPKENPVNVQTMPGKFIVANGGEIGAVVL
DYPPGTSGSPIVDQQGNVIGLYGNGVMINDQTYASAIAQAPAEVARTPTWFTDDMLRKGQLHVLDLHPGAGKTRKVLP
EILKAAVEKRLRTLVLAPTRVVAKEMHEALTGLPVRYQTSAVAPNGSGGELIDVMCHATYTHRQLTPGRGVNYQLYIV
DEAHFTDPASIAARGIIATRVRLGHAAAIFMTATPPGMSNPFPESNAHIEDEEREVPTKAWNAGYEWITDYGGKTVWFV
PSIRMANTIAACLVRAGKTVIVLHSGSFNEEYQKTKSGNWDFVVTTDISEMGANFKASRVIDSRLSIKPMFSYAPSERVV
IGSPRAVSPASAAQRRGRVGRDPRQLGDQYIYGGPVGEDSAEFVHWKEARILMDNVTVPGGLYPQFYEPEGGMCDAM
DGAHRLTDAKREVFRDLMKKGELPVWLAYQVAQAGHAYTDRTWCYGGPADHQVYDDCGQTVDYRSLNGERRMLR
PKWLDQRTYNDKTSLRLFTEFAEGRRRYSELMDVFGRMPQHMLDRTILAADTFKDVLTATPGSRVHRLALDNLPEATE
TMMVVGILSVSTLGVMLFLMSPKGMTRMTCGLVVIILATYFLWVSGMAGYQIAAMQLIAFILFVVLVPEPGSQRSVQD
NTIAIILIVILSLAAIIAANEAGLLEKTKKDFAWKRESHVLVTPSPWNLDFSMDLRPATSWSLYVVMATMLGPVLEHAIV
TNYASVSLTAITNQAGILLSMDKGTPFWNLDWSVVLLCVGSWSGINGTTLMVASTMTVLHFAMILPGIRAKAAREAQN
RTAAGVSKNPLIDGLNTINIQPLPEMDPMYERKMGLWMLIAVAGAAVVFDKRMLHYTEFGVLGSAAVSPLIEGYASAV
WNTSVAASVCNLMRGHVMAGIPMAYSLIRNLSMKGVPRRGLQATHTLGMVWKHKLNAMDKAAFNAYRKDGVTEV
DREPAREAMKKGDLVSGWAVSRGSAKLRWMHERGYIPLQGVVIDLGCGRGGWSYYAAAQRRVTAVKGLTKGGPGH
EEPINVQSYGWNLVTFRSGVDVFHTEVQPADTLLCDIGESSADPAVEKARTVQVLVNFERWIRESRCEHFCCKVLGPYS
PEVMERLDRLTKTYGGAVIRNPLSRNSTHEMYWVSGAKGNPVNAITATSRVLIERMYRRLGKSYWEEDVNLGTGTRA
VSCAAEKPDLAKIGRRIELLKKEYKASWFEDPEHPYKTWTYHGSYETKTTGSSSSMINGVVKEITHPWDTNPRVTTVCM
TDTTPFGQQRVFKEKVDTKAREPSQGTREIMRIVSKWLTLYIGRSKRPRLCTADEFIAKVNADAALGTMFDSQGNWAN
AKEAVRDPRFWQLVAKERELHLRGQCATCVYNMMGKREKKLTEFGKSKGSRAIWFMWLGARFLEFESLGFLNEDHW
LSRENSGGGVEGIGLQYLGYVLKEMALIPGGKMYADDTAGWDTRITNADLEDEMDILGLMDPHHKKLAKNLMELAY
NNKVVRVMRPGKGGKTLMDIISRKDQRGSGQVVTYPLNTWTNLKVQLIRMAESEGVLDPKEIDGITVTTRNNLEKWLT
SQGAERLKRIAASGDDVVVKPVDERFANALTYLNDMAKIRKDISEWKPSAGWFHWEEVPFCSHHFHQLVLKDGRTLV
VPCRDQDELIGRARVSPGAGWTIRETAGLSKAYAQMWLLMHFHRRDLRMAGFAICSAVPSDWVPTGRTSWSLHAKGE
WMTTEDMLAVWNRVWIEDNPHMSNKTLVGSWQDIPYQRKSLDIHCGSMIGQRSRSTWAANIRISIGHVRRLIGTTEKY
LDYMQEQERFKIAEPTRLGNVI

FIG. 69

>SEQ ID NO:394    BinJV/DENV1-prME chimeric ISF vector

AGTATATTTTGCGTGTGCGTTTCAAAACACAGATTGTATTGAAAGTACGTAAGAG
TATAACACGTTGGAATAAAGTTTTGGATCAAGAGGAAAATCATGGTTACAAAACT
CAGGAGGCCCGTTAAACGGGCCGTCGATATGATGAGGCGCGCGGTACCCCGCGC
CGCAGGACCCCGGCGGGTCCTAACTAGGGTATCAAATACCGTGAAGCGTAACGC
AGGCGCTCTTAGAGCTCTTCTGGCTTATCTGCTGTACCAGACATTCTCTGGGCGGA
AAGTTGGTAGTGGTGCTCGGAGCGCCCTTAAGCGCTTCAACAAAAATGACATTGT
GAAAATGTTGCTGGCGTTCAGACGGACATTGACAAACATCATCACAACCATGCAG
CGTCGTGTGAAAGGAAAGAAACGTCGTGGCGTTCAAGATGTGCCGCTATTGGTCT
TGCTGCTCGTTGGAGCAGGAGCGATGGCTTTCCATCTGACCACCCGAGGGGGAGA
GCCGCACATGATAGTTAGCAAGCAGGAAGAGGAAAGTCACTTTTGTTTAAGAC
CTCTGCAGGTGTCAACATGTGTACCCTTATTGCAATGGATTTGGGAGAGTTATGT
GAAGACACAATGACCTACAAATGCCCCGGATCACTGAAACGGAACCAGATGAC
GTTGACTGCTGGTGCAACGCCACGGAGACATGGGTGACTTATGGAACATGTTCTC
AAACTGGTGAACACCGACGAGACAAACGTTCCGTCGCACTGGCACCACACGTAG
GGCTTGGTCTAGAAACAAGAACCGAAACGTGGATGTCCTCTGAAGGCGCTTGGA
AACAAATACAAAAAGTGGAGACCTGGGCTCTGAGACACCCAGGATTCACGGTGA
TAGCTCTTTTTCTAGCACATGCCATAGGAACATCCATCACCCAGAAAGGAATTAT
TTTCATTTTGCTGATGCTGGTAACTCCATCCATGGCCATGCGGTGCGTGGGAATAG
GCAACAGAGACTTCGTGGAAGGACTGTCAGGAGCTACGTGGGTGGATGTGGTAC
TGGAGCATGGAAGTTGTGTTACTACCATGGCAAAAGACAAACCAACACTGGATA
TTGAACTCTTAAAAACGGAGGTCACAAACCCAGCCGTCCTGCGCAAACTGTGCAT
TGAAGCCAAAATATCAAATACCACCACCGATTCGAGATGTCCAACACAAGGAGA
AGCCACGCTGGTGGAAGAACAAGACACGAACTTTGTGTGTCGACGAACGTTCGT
GGACAGAGGCTGGGGCAATGGTTGTGGGCTATTCGGAAAAGGCAGCTTAATAAC
ATGTGCTAAGTTTAAGTGTGTGACAAAACTGGAAGGAAAGATAGTCCAATATGA
AAATTTAAAATATTCAGTGATAGTCACCGTCCACACTGGAGACCAGCACCAAGTT
GGAAATGAGACTACAGAACATGGAACAACTGCAACCATAACACCTCAAGCTCCC
ACGTCGGAAATACAGCTGACAGACTACGGAGCTCTAACACTGGACTGTTCACCCA
GAACAGGGCTAGACTTTAATGAGATGGTGTTGTTGACAATGAAAGAAAAATCAT
GGCTCGTCCACAAACAATGGTTTCTAGACTTACCGCTGCCTTGGACCTCAGGGGC
TTCAACATCCCAAGAGACTTGGAATAGACAAGACTTGCTGGTCACATTCAAGACA
GCTCATGCAAAGAAGCAGGAAGTAGTTGTACTAGGATCACAAGAAGGAGCGATG
CACACTGCGTTGACTGGAGCGACAGAAATCCAAACGTCTGGAACGACAACAATT
TTCGCAGGACACCTGAAATGCAGACTGAAAATGGATAAACTGACTTTAAAAGGG
GTATCATATGTAATGTGCACAGGCTCATTCAAGCTAGAAAAGGAAGTGGCTGAG
ACCCAACATGGAACCGTTCTAGTGCAGGTTAAGTACGAAGGAACAGATGCACCA
TGTAAGATCCCCTTCTCATCCCAAGATGAGAGGGGAGTAATCCAGAATGGGAGAT
TGATAACAGCCAACCCCATAGTCACTGACAAAGAAAAACCAGTTAACATCGAGG
CGGAGCCACCTTTTGGTGAGAGCTACATCGTGGTAGGAGCAGGTGAAAAAGCTTT
GAAACTAAGCTGGTTCAAGAAGGGAAGCAGTATAGGGAAATGTTTGAAGCAAC
TGCCCGTGGAGCACGAAGGATGGCCATCCTGGGAGACACTGCATGGGACTTCGG
TTCTATAGGAGGAGTGTTCACGTCCGTGGGAAAACTGGTACACCAGATTTTGGA
ACTGCGTATGGAGTCTTGTTCAGCGGTGTTTCTTGGACCATGAAAATAGGAATAG
GGATTCTGCTGACATGGCTAGGGTTAAATTCAAGGAGCACATCCCTTTCAATGAC
GTGTATCGCAGTTGGCATGGTTACACTGTACCTAGGAGTCATGGTTCAGGCGCTA
TCGGAAATAGGATGCAGTCTGGACATTAGCCGAAAAGAAATGAAGTGTGGGGAC
GGAGTCTTCATCTTCAGAGAGGCAGGCATGTGGAAGGATGGGTATGCGTTCCACC

FIG. 70

CTTCCGAACCCAAATCTCTGGCCGCGTCAGTTCTCAAGAGTTGGCAGTCTGGAGT
GTGCGGCGTGCGCTCCACGAACAGAATGGAACATGCCATGTGGAAACAGATTGA
AAATGAATTGAACGGCATTCTAGAAGAGAATGAGGCGCAACTCAGCGTGGTTGT
GCGAGAGTCTAACGGGACCTTCCCGAGAGGAGAGCGCCGCATGCACGTGGCCGA
ACCTCTGCGCTATGGATGGAAGACCTGGGGAAAGACCGCAATTTCGACGGTGCC
GCTCGCTAAAGAAACGTTTGTGGTAGATGGCAATGATGAAGGAGAATGTCCCTCT
CAAATGCGTGCTTGGAATTCCTTCCAAGTTGAAGAGTTCGGAACTGGGCTGGTGA
AAACCAAAGTGTTCTTGGACATATCCACTGCTCTCACCGCCCAATGTGACACCAA
AATGCTGGGCGCTGCCATAAAGGGGAATAGGTCTGTTCATGGAGATCCAGGTCTC
TGGATGGTCTCAGCTGAAATCGATGGGACATGGCAGATAATAGAGCTCACATTGG
CAGAGAGCAGGCGTTGCACATGGCCAGACTCTCACACCGTGTGGGGTAGGAATG
TCCAGGAGAGTGAGTTGATACTGCCACCGTCTTTCGGAGGACCGATGACCAACAT
GAACAAGCGTAAAGGCTACGCGACCCAAGTGGGAGGACCATGGAACCATGTTCC
ACTACGAGTAGTTTTTGAAGAGTGTCCGGGAACCACTGTATCTGTTGAACCAAAC
TGCACCAGGAGATCGGATTCAGTGCGATCCACAACTGATAGCGGCAAGATTATA
ACCGACTGGTGTTGTCGTTCCTGTACAATGCCTCCCCTAACGTACCGAACCCCCG
ATGGATGCTGGTATGCAATGGAAATCAGGCCCAAGAATGTTAAAGAGGAGAGTC
TGATCCGTTCGCATGTGGCGGCAGGTGTGTTTAAAGGCATTGACGACGTGTCACT
GGGGCTGTTAGTAATGATAATTTTCCTGCAGGAAGGTTTGAGAAGAAAGTTAACT
GCAACGTATATCATGTGGGCTGCTCTTGTGGTCCTCATTGCAGGAATCCTAGGGG
AACTCACAGTGAGGGATGTGCTCAGGTATCTCATCCTAGTCGGCACTGCATTCGC
TGAGAGTAATAATGGAGGAGATTTAATACATCTGGCCCTAGTGGCGGTCTTCAAG
ATTAGGCCGGCATTCTTATTTGGATTCTTGTTCAGGAGTCAGTGGTCCCCAGAGA
AGGTGTGTTGCTGGCATCTGGAGCGCTGATGCTGCAGATTGCAAGTGAGTGCTTG
CACGCATCGGCGATTATGCAGGTTGTCGATTCCTTGAGCATGGGGTGGTTGATGA
TCAGAGCCATTGCTGTACCTGGTATGACCTCAAAAGCCATGCCACTGCTGTGTGC
CTGCATTCCTGCAGTTACGAGCCTACTGGCCCACTCAACCAGAGCCGGTATAATC
ACCATGGCCGGCATGTCGCTTATTGCAGGAAGTAAGGGATCATCAGTTAAAAAAC
ACAGTCCATACATGCTTGCCCTCGTGGTGGCAGGCCTCGGAGCCCGTCCCATAGG
AATGTTGGCGATGGAAGCCTTCTCTCACCTGAAGGGCCGGAGATCATGGCCGGCT
GGTGAGATGATGTCAGCCGTTGGGCTGACATGTGCGCTAGTGGGAGCTATCAGTG
GCGCATCATCTCAGGACTTCGCCGGACCTCTAGCAGCAGCGGCTCTAATTATTAT
TGCATATGCCATTAGTGGACGCTCAGCTGATGTATACCTTGAGAAAGCCGGTGAG
ATATCCTGGAGTGAGGACGCTAAAATATCCGGATCAAGCCCGCGCATTGATGTGT
GCGTTACCGAAAATGGAGATTTCAAATTGCGTCATGAGAGTGAAGCAACCTGGA
CCCGGAATTGTGTCTTGGCTGCTTGCTTAGTCGTAGCCGGAGTGCACCCACTGGG
GATTCCAGTAGCAGGGTTGATGTGGTTTGGATATGTGAAATCAAACAAGCGGGG
GACTGTGTTGTGGGACATTCCCTCACCACAGGCAACATCAGCTCCAACGGTGGAA
GATGGATGCTACCGCGTTATGTCACGTAGACTGCTTGGCAGCACTCAGCTTGGTG
TTGGGATCATGCTAGACTCTACATTTCACACAATGTGGCACATAACCCGAGGAGC
ATCTATTGTTAGTGGTGAAGGGCGTCTTGACCCATATTGGGCTGACGTTAAGGAA
GACCTGGTCTGTTACGGAGGGCCATGGAAAATCCGCAACACATGGGATGGACTCT
CAGAAGTTCAGCTGATAGCGGTGGCCCCAAAAGAGAATCCCGTGAACGTCCAAA
CAATGCCAGGAAAGTTCATTGTGGCGAATGGAGGTGAGATAGGAGCCGTTGTGC
TCGACTATCCTCCTGGAACTTCTGGTTCACCCATCGTGGATCAGCAGGGTAATGTC
ATAGGACTGTATGGCAACGGGGTTATGATCAATGACCAAACGTATGCGAGTGCC
ATTGCGCAAGCTCCAGCTGAAGTTGCGCGCACCCCAACCTGGTTCACTGATGATA
TGTTGCGAAAGGGACAATTGCATGTGCTAGACTTGCACCCTGGAGCGGGAAAAA
CCCGCAAGG

FIG. 70 cont.

```
TCCTGCCTGAGATTCTCAAAGCAGCGGTGGAGAAACGGCTACGCACGTTGGTCCT
GGCCCCAACCAGAGTTGTGGCAAAGGAAATGCATGAAGCATTGACCGGGCTGCC
GGTACGCTACCAGACATCAGCAGTGGCACCAAATGGTTCTGGAGGAGAATTGATT
GATGTCATGTGCCATGCAACATACACACACCGCCAGCTGACACCGGGACGGGGG
GTCAACTACCAGTTATACATAGTGGATGAGGCACATTTTACAGATCCCGCTTCCA
TCGCAGCTCGCGGCATCATTGCGACTAGGGTGCGATTGGGACATGCCGCAGCAAT
CTTCATGACGGCCACACCCCGGGAATGTCAAACCCATTCCGGAGTCTAATGCT
CACATTGAAGACGAAGAGCGGGAGGTACCCACCAAAGCTTGGAACGCTGGATAT
GAGTGGATAACAGACTATGGGGGAAAAACCGTGTGGTTCGTGCCTTCCATCCGGA
TGGCGAACACCATAGCTGCATGCTTGGTACGAGCAGGCAAGACAGTCATTGTACT
GCACAGTGGCTCTTTCAATGAAGAATATCAAAAAACCAAGTCTGGCAATTGGGAT
TTCGTTGTGACGACCGACATCTCAGAAATGGGGGCCAATTTCAAAGCCTCTAGGG
TCATAGACTCTAGACTGTCCATAAAACCGATGTTTCCTACGCTCCCAGTGAGCG
AGTGGTTATTGGCTCACCTAGAGCGGTTTCTCCAGCCAGCGCAGCACAGCGCCGA
GGGAGAGTCGGGAGAGACCCTCGTCAACTGGGCGACCAGTATATCTATGGTGGA
CCAGTAGGAGAAGACTCGGCCGAGTTCGTTCATTGGAAGGAAGCAAGGATCCTC
ATGGATAATGTAACTGTCCCTGGGGGCTTGTATCCACAATTCTACGAACCAGAGG
GTGGAATGTGTGACGCCATGGATGGAGCTCACCGACTGACCGATGCTAAGAGAG
AAGTGTTCCGAGACCTCATGAAGAAAGGGGAACTTCCTGTATGGTTAGCATACCA
GGTGGCCCAGGCTGGGCATGCGTACACTGACAGAACTTGGTGCTATGGGGGCC
GGCGGATCATCAAGTGTATGATGATTGCGGCCAAACCGTGGATTACAGGTCCCTT
AATGGAGAGAGGCGTATGCTACGTCCCAAGTGGCTTGATCAGCGCACCTACAAC
GACAAAACATCCTTAAGGCTCTTCACGGAATTTGCAGAGGGACGCCGCCGATATT
CGGAACTAATGGACGTGTTTGGAAGAATGCCCCAACACATGTTGGACAGGACCA
TCTTGGCTGCAGACACGTTTAAAGATGTCCTGACAGCAACACCGGGATCTCGTGT
GCACCGTTTAGCACTGGACAATTTACCCGAAGCTACAGAAACTATGATGGTAGTG
GGAATCCTGAGTGTCTCGACCCTAGGCGTTATGCTATTTCTGATGTCACCCAAGG
GCATGACCCGGATGACCTGCGGACTTGTGGTGATCATCCTGGCGACGTATTTCT
ATGGGTGTCAGGAATGGCCGGCTACCAGATAGCAGCAATGCAACTCATCGCGTTC
ATTCTGTTTGTGGTCTTGGTGCCAGAGCCAGGGTCACAGAGATCAGTGCAAGACA
ACACCATAGCGATAATTCTCATAGTCATCCTGTCGTTGGCTGCCATCATAGCCGCC
AATGAAGCAGGATTGCTAGAGAAGACCAAAAAGGATTTCGCGTGGAAGAGGGAG
AGTCATGTGCTGGTGACTCCGAGTCCGTGGAACCTGGATTTCTCAATGGATTTGA
GGCCAGCCACCAGCTGGTCATTGTATGTGGTGATGGCCACCATGTTAGGGCCAGT
ACTGGAACACGCCATTGTCACCAATTATGCTAGCGTCTCACTTACTGCCATCACA
AACCAGGCAGGAATACTGCTGTCAATGGATAAGGGCACTCCTTTCTGGAATCTTG
ACTGGAGTGTTGTCCTGTTGTGCGTGGGCAGCTGGTCGGGGATCAATGGCACTAC
ACTAATGGTTGCTTCCACAATGACAGTTTTGCATTTTGCCATGATACTACCTGGCA
TTCGTGCCAAAGCGGCGAGAGAAGCACAGAATCGAACAGCAGCTGGGGTGTCAA
AGAACCCTCTTATTGATGGGTTAAACACCATAAACATCCAGCCGTTGCCGGAAAT
GGACCCCATGTACGAAAGGAAATGGGGCTATGGATGCTAATCGCTGTTGCCGG
AGCCGCGGTGGTTTTGACAAGAGAATGCTCCATTACACCGAGTTCGGAGTATTG
GGTTCAGCTGCTGTGAGTCCTCTCATTGAAGGATACGCGTCTGCTGTTTGGAACA
CTTCCGTAGCAGCCAGTGTGTGCAACCTAATGCGAGGCCATTACATGGCGGGAAT
CCCAATGGCATACTCTCTGATCAGAAATCTATCCATGAAGGAGTTCCTAGGAGG
GGATTACAGGCCACCCATACCCTTGGTATGGTTTGGAAACACAAATTAAACGCCA
TGGACAAGGCGGCCTTTAACGCATACCGGAAGGATGGAGTGACAGAAGTGGATA
GGGAGCCAGCACGTGAAGCTATGAAGAAGGAGATTTGGTGAGCGGATGGGCGG
TCTCTCGAGGGTCAGCCAAGCTGCGATGGATGCACGAGCGTGGATACATTCCCT
ACAAGGAGTTGTCATTGACCTCGGATGTGGAAGAGGGGGTGGAGTTACTACGC
TGCTGCACAACGCCGGGTGACCGCTGTCAAAGGGCTCACGAAAGGCGGACCAGG
```

FIG. 70 cont.

```
GCATGAGGAGCCAATCAACGTCCAGTCATATGGATGGAACTTAGTGACGTTCCGT
AGTGGAGTGGATGTCTTTCACACCGAAGTCCAGCCGGCTGACACCCTGTTGTGCG
ACATAGGAGAGTCTTCTGCTGACCCCGCTGTCGAAAAAGCGCGCACAGTACAAGT
GTTGGTGAACTTTGAAAGATGGATTAGAGAGTCGCGGTGTGAGCATTTTTGTTGC
AAGGTGCTTGGTCCCTACTCTCCCGAAGTGATGGAGCGCTTAGATCGTTTAACAA
AGACATATGGAGGAGCGGTAATTCGCAACCCACTATCCAGGAACTCCACGCATG
AGATGTACTGGGTGTCAGGAGCTAAGGGTAATCCAGTCAATGCTATAACAGCCAC
CTCACGTGTGCTAATCGAACGCATGTACAGAAGACTTGGCAAGAGTTACTGGGAA
GAAGATGTGAATCTTGGTACTGGGACCCGTGCAGTTTCATGTGCCGCGGAGAAGC
CAGATCTAGCAAAAATCGGAAGGCGCATTGAGTTGCTGAAGAAGGAGTATAAAG
CATCATGGTTCGAGGATCCAGAGCATCCCTACAAGACATGGACATACCATGGTTC
CTACGAAACCAAGACCACAGGCAGCTCGTCTAGTATGATTAATGGCGTTGTCAAG
GAGATCACTCACCCTTGGGATACCAACCCAAGGGTTACAACCGTCTGTATGACCG
ACACCACTCCTTTTGGACAGCAGAGAGTATTCAAGGAAAAGGTAGATACCAAGG
CACGTGAGCCATCTCAAGGGACGCGGGAGATCATGAGAATAGTGAGCAAGTGGC
TCACACTATATATTGGTCGGAGCAAGCGCCCTAGGCTGTGCACAGCGGATGAATT
CATAGCCAAAGTTAATGCTGATGCCGCTCTCGGCACGATGTTCGACTCGCAGGGA
AACTGGGCGAACGCCAAAGAAGCTGTGCGCGACCCACGGTTTTGGCAGTTGGTG
GCCAAAGAGAGGGAACTTCACCTGCGTGGACAGTGTGCCACGTGTGTTTACAACA
TGATGGGGAAGCGAGAGAAAAAGCTGACAGAGTTTGGGAAGTCGAAGGGGAGC
CGAGCAATTTGGTTTATGTGGCTAGGAGCTAGGTTCTTGGAGTTTGAAAGTTTAG
GCTTCCTAAACGAGGATCATTGGTTGTCACGTGAAAACTCAGGAGGTGGAGTTGA
GGGCATTGGATTGCAATACCTTGGGTATGTGTTGAAAGAAATGGCACTAATTCCC
GGGGGCAAGATGTACGCCGATGACACCGCTGGGTGGGACACCAGAATTACTAAC
GCTGACCTTGAGGATGAGATGGACATATTGGGACTTATGGACCCGCATCACAAAA
AACTGGCAAAAAATCTGATGGAGTTGGCGTACAACAACAAGGTGGTCAGAGTGA
TGCGCCCTGGTAAAGGGGGAAAAACACTAATGGACATCATTAGCCGCAAGGACC
AGCGGGGAAGTGGACAAGTGGTCACCTACCCACTCAACACGTGGACGAATCTCA
AGGTCCAATTGATCCGTATGGCAGAGTCAGAGGGAGTGTTGGACCCCAAGGAGA
TCGATGGAATCACTGTCACGACTCGGAATAACCTGGAAAAATGGCTCACTAGCCA
AGGGGCTGAGCGTCTAAAGCGCATTGCAGCTAGCGGTGACGACGTTGTGGTAAA
ACCAGTGGATGAGAGATTCGCCAATGCTCTCACCTATCTAAACGACATGGCCAAA
ATTAGGAAGGACATCAGTGAGTGGAAACCATCCGCGGGGTGGTTCCACTGGGAA
GAAGTGCCATTCTGCTCACACCATTTTCACCAGTTGGTCCTCAAGGATGGGCGCA
CCTTAGTGGTCCCATGCCGTGACCAGGATGAACTAATTGGAAGGGCAAGAGTGTC
ACCTGGTGCTGGATGGACTATCAGAGAAACTGCAGGTCTAAGCAAGGCCTATGCC
CAGATGTGGCTTCTAATGCACTTCCACCGGAGGGACCTCAGAATGGCAGGTTTCG
CCATTTGTAGTGCTGTCCCCAGTGATTGGGTGCCCACGGGAAGGACATCGTGGTC
ACTGCACGCTAAAGGGGAGTGGATGACCACTGAAGACATGTTAGCAGTTTGGAA
CAGAGTGTGGATTGAAGACAATCCCCACATGTCTAACAAGACTTTAGTGGGATCA
TGGCAAGACATCCCGTACCAGAGGAAATCCCTGGACATCCACTGTGGCTCAATGA
TAGGGCAGCGGTCTAGGTCAACATGGGCTGCTAACATACGAATTAGCATTGGACA
CGTGCGCCCGATTGATTGGAACCACGGAAAAGTACTTGGATTACATGCAGGAGCA
GGAGCGGTTCAAGATTGCTGAACCAACCCGTCTGGGCAATGTGATCTAAGGATCT
ACGAACGAGAATAAGTAGAAGAACGGAACGACAGAGTCAGGCCTCAAATGAGC
CAGCATTAATGAGAGTAAGTGCTGCTGCCTGTGCCTCTCCTTAACACGTGGTAGC
GCCACTCGTGTTTCGTTACCTAATAGCGCTAGAGTCAGACCCAAGTAGGCCAGGG
CTATGGTTGTAAGCCCTGCTGTCTGTGGCAGCCATCCAGTGGTAATGCGTCGCAC
CACTAAGGA
```

FIG. 70 cont.

```
TTAATAGACGTATATTGGGAGGGACTGGTGAGGAGCAGCAAGCTCGAGCTGCAT
CACCCACTGGTACTATCGGTTAGAGGAAACCCCCTCCAAAATGTAGAGCATCATA
TCGACACCTGGGAAAGACCGGAGATACCTCTTGCTTCACAGCACTCAATCCACAA
GGCACAGATCGCCGAATAATTGTGGATTGGGGATTGAGAAACATCAAGTATCTG
GGTCGGCATGGCATCTCCACCTCCTCGCGGTCCGACCTGGGCATCCGAAGGAGGA
CGTCGTCCACTCGGATGGCTAAGGGAGAGCCACTTTTCTCTCGATTCTCTATCGGA
ATCTAGGGAGCTCGGATCCAGACATGATAAGATACATTGATGAGTTTGGACAAAC
CACAACTAGAATGCAGTGAAAAAAATGCTTTATTTGTGAAATTTGTGATGCTATT
GCTTTATTTGTAACCATTATAAGCTGCAATAAACAAGTTAACAACAACAATTGCT
CGAGGGGGGGCCCGGTACCTTGAAGCTGTCCCTGATGGTCGTCATCTACCTGCCT
GGACAGCATGGCCTGCAACGCGGGCATCCCGATGCCGCCGGAAGCGAGAAGAAT
CATAATGGGGAAGGCCATCCAGCCTCGCGTCGGCGCTTAAGGATCATGATGATAA
ACAATGTATGGTGCTAATGTTGCTTCAACAACAATTCTGTTGAACTGTGTTTTCAT
GTTTGCCAACAAGCACCTTTATACTCGGTGGCCTCCCCACCACCAACTTTTTTGCA
CTGCAAAAAAACACGCTTTTGCACGCGGGCCCATACATAGTACAAACTCTACGTT
TCGTAGACTATTTTACATAAATAGTCTACACCGTTGTATACGCTCCAAATACACTA
CCACACATTGAACCTTTTGCAGTGCAAAAAAGTACGTGTCGGCAGTCACGTAGG
CCGGCCTTATCGGGTCGCGTCCTGTCACGTACGAATCACATTATCGGACCGGACG
AGTGTTGTCTTATCGTGACAGGACGCCAGCTTCCTGTGTTGCTAACCGCAGCCGG
ACGCAACTCCTTATCGGAACAGGACGCGCCTCCATATCAGCCGCGCGTTATCTCA
TGCGCGTGACCGGACACGAGGCGCCCGTCCCGCTTATCGCGCCTATAAATACAGC
CCGCAACGATCTGGTAAAC
```

FIG. 70 cont.

\>SEQ ID NO:395        BinJV/DENV1-prME ORF aa sequence

MVTKLRRPVKRAVDMMRRAVPRAAGPRRVLTRVSNTVKRNAGALRALLAYLLYQTFSGRK
VGSGARSALKRFNKNDIVKMLLAFRRTLTNIITTMQRRVKGKKRRGVQDVPLLVLLLVGA
GAMAFHLTTRGGEPHMIVSKQERGKSLLFKTSAGVNMCTLIAMDLGELCEDTMTYKCPRI
TETEPDDVDCWCNATETWVTYGTCSQTGEHRRDKRSVALAPHVGLGLETRTETWMSSEGA
WKQIQKVETWALRHPGFTVIALFLAHAIGTSITQKGIIFILLMLVTPSMAMRCVGIGNRD
FVEGLSGATWVDVVLEHGSCVTTMAKDKPTLDIELLKTEVTNPAVLRKLCIEAKISNTTT
DSRCPTQGEATLVEEQDTNFVCRRTFVDRGWGNGCGLFGKGSLITCAKFKCVTKLEGKIV
QYENLKYSVIVTVHTGDQHQVGNETTEHGTTATITPQAPTSEIQLTDYGALTLDCSPRTG
LDFNEMVLLTMKEKSWLVHKQWFLDLPLPWTSGASTSQETWNRQDLLVTFKTAHAKKQEV
VVLGSQEGAMHTALTGATEIQTSGTTTIFAGHLKCRLKMDKLTLKGVSYVMCTGSFKLEK
EVAETQHGTVLVQVKYEGTDAPCKIPFSSQDERGVIQNGRLITANPIVTDKEKPVNIEAE
PPFGESYIVVGAGEKALKLSWFKKGSSIGKMFEATARGARRMAILGDTAWDFGSIGGVFT
SVGKLVHQIFGTAYGVLFSGVSWTMKIGIGILLTWLGLNSRSTSLSMTCIAVGMVTLYLG
VMVQALSEIGCSLDISRKEMKCGDGVFIFREAGMWKDGYAFHPSEPKSLAASVLKSWQSG
VCGVRSTNRMEHAMWKQIENELNGILEENEAQLSVVVRESNGTFPRGERRMHVAEPLRYG
WKTWGKTAISTVPLAKETFVVDGNDEGECPSQMRAWNSFQVEEFGTGLVKTKVFLDISTA
LTAQCDTKMLGAAIKGNRSVHGDPGLWMVSAEIDGTWQIIELTLAESRRCTWPDSHTVWG
RNVQESELILPPSFGGPMTNMNKRKGYATQVGGPWNHVPLRVVFEECPGTTVSVEPNCTR
RSDSVRSTTDSGKIITDWCCRSCTMPPLTYRTPDGCWYAMEIRPKNVKEESLIRSHVAAG
VFKGIDDVSLGLLVMIIFLQEGLRRKLTATYIMWAALVVLIAGILGELTVRDVLRYLILV
GTAFAESNNGGDLIHLALVAVFKIRPAFLFGFLFRSQWSPREGVLLASGALMLQIASECL
HASAIMQVVDSLSMGWLMIRAIAVPGMTSKAMPLLCACIPAVTSLLAHSTRAGIITMAGM
SLIAGSKGSSVKKHSPYMLALVVAGLGARPIGMLAMEAFSHLKGRRSWPAGEMMSAVGLT
CALVGAISGASSQDFAGPLAAAALIIIAYAISGRSADVYLEKAGEISWSEDAKISGSSPR
IDVCVTENGDFKLRHESEATWTRNCVLAACLVVAGVHPLGIPVAGLMWFGYVKSNKRGTV
LWDIPSPQATSAPTVEDGCYRVMSRRLLGSTQLGVGIMLDSTFHTMWHITRGASIVSGEG
RLDPYWADVKEDLVCYGGPWKIRNTWDGLSEVQLIAVAPKENPVNVQTMPGKFIVANGGE
IGAVVLDYPPGTSGSPIVDQQGNVIGLYGNGVMINDQTYASAIAQAPAEVARTPTWFTDD
MLRKGQLHVLDLHPGAGKTRKVLPEILKAAVEKRLRTLVLAPTRVVAKEMHEALTGLPVR
YQTSAVAPNGSGGELIDVMCHATYTHRQLTPGRGVNYQLYIVDEAHFTDPASIAARGIIA
TRVRLGHAAAIFMTATPPGMSNPFPESNAHIEDEEREVPTKAWNAGYEWITDYGGKTVWF
VPSIRMANTIAACLVRAGKTVIVLHSGSFNEEYQKTKSGNWDFVVTTDISEMGANFKASR
VIDSRLSIKPMFSYAPSERVVIGSPRAVSPASAAQRRGRVGRDPRQLGDQYIYGGPVGED
SAEFVHWKEARILMDNVTVPGGLYPQFYEPEGGMCDAMDGAHRLTDAKREVFRDLMKKGE
LPVWLAYQVAQAGHAYTDRTWCYGGPADHQVYDDCGQTVDYRSLNGERRMLRPKWLDQRT
YNDKTSLRLFTEFAEGRRRYSELMDVFGRMPQHMLDRTILAADTFKDVLTATPGSRVHRL
ALDNLPEATETMMVVGILSVSTLGVMLFLMSPKGMTRMTCGLVVIILATYFLWVSGMAGY
QIAAMQLIAFILFVVLVPEPGSQRSVQDNTIAIILIVILSLAAIIAANEAGLLEKTKKDF
AWKRESHVLVTPSPWNLDFSMDLRPATSWSLYVVMATMLGPVLEHAIVTNYASVSLTAIT
NQAGILLSMDKGTPFWNLDWSVVLLCVGSWSGINGTTLMVASTMTVLHFAMILPGIRAKA
AREAQNRTAAGVSKNPLIDGLNTINIQPLPEMDPMYERKMGLWMLIAVAGAAVVFDKRML
HYTEFGVLGSAAVSPLIEGYASAVWNTSVAASVCNLMRGHYMAGIPMAYSLIRNLSMKGV
PRRGLQATHTLGMVWKHKLNAMDKAAFNAYRKDGVTEVDREPAREAMKKGDLVSGWAVSR
GSAKLRWMHERGYIPLQGVVIDLGCGRGGWSYYAAAQRRVTAVKGLTKGGPGHEEPINVQ
SYGWNLVTFRSGVDVFHTEVQPADTLLCDIGESSADPAVEKARTVQVLVNFERWIRESRC
EHFCCKVLGPYSPEVMERLDRLTKTYGGAVIRNPLSRNSTHEMYWVSGAKGNPVNAITAT
SRVLIERMYRRLGKSYWEEDVNLGTGTRAVSCAAEKPDLAKIGRRIELLKKEYKASWFED
PEHPYKTWTYHGSYETKTTGSSSSMINGVVKEITHPWDTNPRVTTVCMTDTTPFGQQRVF
KEKVDTKAREPSQGTREIMRIVSKWLTLYIGRSKRPRLCTADEFIAKVNADAALGTMFDS
QGNWANAKEAVRDPRFWQLVAKERELHLRGQCATCVYNMMGKREKKLTEFGKSKGSRAIW
FMWLGARFLEFESLGFLNEDHWLSRENSGGGVEGIGLQYLGYVLKEMALIPGGKMYADDT
AGWDTRITNADLEDEMDILGLMDPHHKKLAKNLMELAYNNKVVRVMRPGKGGKTLMDIIS
RKDQRGSGQVVTYPLNTWTNLKVQLIRMAESEGVLDPKEIDGITVTTRNNLEKWLTSQGA
ERLKRIAASGDDVVVKPVDERFANALTYLNDMAKIRKDISEWKPSAGWFHWEEVPFCSHH
FHQLVLKDGRTLVVPCRDQDELIGRARVSPGAGWTIRETAGLSKAYAQMWLLMHFHRRDL
RMAGFAICSAVPSDWVPTGRTSWSLHAKGEWMTTEDMLAVWNRVWIEDNPHMSNKTLVGS
WQDIPYQRKSLDIHCGSMIGQRSRSTWAANIRISIGHVRRLIGTTEKYLDYMQEQERFKI
AEPTRLGNVI

FIG. 71

SEQ ID NO:396    BinJV$_{V106G}$ vector

```
   1 gggtcggcat ggcatctcca cctcctcgcg gtccgacctg ggcatccgaa ggaggacgtc
  61 gtccactcgg atggctaagg gagagccact tttctctcga ttctctatcg gaatctaggg
 121 agctcggatc cagacatgat aagatacatt gatgagtttg gacaaaccac aactagaatg
 181 cagtgaaaaa aatgctttat ttgtgaaatt tgtgatgcta ttgctttatt tgtaaccatt
 241 ataagctgca ataaacaagt taacaacaac aattgctcga gggggggccc ggtaccttga
 301 agctgtccct gatggtcgtc atctacctgc ctggacagca tggcctgcaa cgcgggcatc
 361 ccgatgccgc cggaagcgag aagaatcata atggggaagg ccatccagcc tcgcgtcggc
 421 gcttaaggat catgatgata acaatgtat ggtgctaatg ttgcttcaac aacaattctg
 481 ttgaactgtg ttttcatgtt tgccaacaag cacctttata ctcggtggcc tccccaccac
 541 caactttttt gcactgcaaa aaaacacgct tttgcacgcg ggcccataca tagtacaaac
 601 tctacgtttc gtagactatt ttacataaat agtctacacc gttgtatacg ctccaaatac
 661 actaccacac attgaaacctt tttgcagtgc aaaaaagtac gtgtcggcag tcacgtaggc
 721 cggccttatc gggtcgcgtc ctgtcacgta cgaatcacat tatcggaccg gacgagtgtt
 781 gtcttatcgt gacaggacgc cagcttcctg tgttgctaac cgcagccgga cgcaactcct
 841 tatcggaaca ggacgcgcct ccatatcagc cgcgcgttat ctcatgcgcg tgaccggaca
 901 cgaggcgccc gtcccgctta tcgcgcctat aaatacagcc cgcaacgatc tggtaaacag
 961 tatattttgc gtgtgcgttt caaaacacag attgtattga aagtacgtaa gagtataaca
1021 cgttggaata agttttgga tcaagaggaa aatcatggtt acaaaactca ggaggcccgt
1081 taaacgggcc gtcgatatga tgaggcgcgc ggtaccccgc gccgcaggac cccggcgggt
1141 cctaactagg gtatcaaata ccgtgaagcg taacgcaggc gctcttagag ctcttctggc
1201 ttatctgctg taccagacat tctctgggcg gaaagttggt agtggtgctc ggagcgccct
1261 taagcgcttc aacaaaaatg acattgtgaa aatgttgctg gcgttcagac ggacattgac
1321 aaacatcatc acaaccatgc agcgtcgtgt gaaaggaaag aaacgtcgtg gcgttcaaga
1381 tgtgccgcta ttggtcttgc tgctcgttgg agcaggagcg atggctgcca ctttacgcac
1441 cgttggagac ttgacatggc taaatgtgtc aaccactgat gttggaaagt ggatacgtgt
1501 ggagaatagg cacggcaaag gagagtgttt cgtcacggcc actgacgttg aacatggtg
1561 ctcagactct gtgggatatg aatgtcctca aattgcaccg gcgtatgacc ctgaagactt
1621 ggattgctac tgccgaaaca cctcaaccta cgttacttat ggaaggtgta aaaatgggcg
1681 cagtggacga tctcgcagca agagagcaat cacgatagcc ccgcacggcg aagcaggatt
1741 gcgtgttgga agcaccaagc attggacttc tagagcaact ccacaacggt atctaatgcg
1801 cgttgagaaa tgggtgctgc ggcatcctct acctgctctc gtgttggtgg tactgggatg
1861 gatgatgggt cgttctcacg gccagagggc catgtatata gtgctgatgc tgcttgtggc
1921 tccgtcatat ggtaaccaat gcctggatgt gcagtcacgt gatttcgtgc aaggggttag
1981 tggtggcacc tgggtagatg ttgttttgga tcatgacaat tgcataacca ttgttgctga
2041 cgggaaacca tcttttgata ttcgtttgtc gaaaatgagc atgtctaaat tcgcagagta
2101 caaacggtat tgcctccagg ccacgatgag tgatgtcact agcatagtgg cgtgtccagg
2161 ggctggggat gctcataatg acaagagcaa aaaccacgag tacatttgca aagctgttaa
2221 caatgaccgc ggatggggca atgggtgtgt cctttttggc aaaggatcaa tggaaacttg
2281 tggtaagttt gaatgtaaga agaaaatggc tggcaagtta gtggcacgtg agaacgtgga
2341 atcagtggtc actgtgcatg tacatggtgc cactactgtg gagtcgcacg gaaactactc
2401 cacacaggtt ggagccactc aggcagggaa agcgactatc acgccaaaag cttctgtggc
2461 tactctaaat ttaaacgact tggtagcct ggaggtggat tgttcaactg atgttggcat
2521 ggactttgga gagattgtgg tggccgacat gtcaggaaag tggtggatcg tgaacaagga
2581 ttggttcaat gaacttgctt tgccgtggtc cacggctagc accactgctg aagtttggca
2641 ggcacgagac agacttgttg agtttggatg gccacatgcg gccaagcaga acatctatga
2701 cattggggac caagaaggag ctgtgacggc tgccatagcc caggcaccca tggcgaaatg
2761 ggagtctgac aaggtcgagc taatctctgg gattctcaag tgcaaggtga aacttggcaa
2821 cctaaagctg cgtggggtga cctatagcat gtgtgcccag acattcacca cggaaacaag
2881 gccggccgac accggacatg gcactgtggc ttcaaggtg aaatacgtcg aacagacgt
2941 gccttgccgg gtcccactcc acatcataga cagtgacggc ggagtggccg ctggacgagt
```

FIG. 72

```
3001 gataacggca caccccttcg tcatgaagca gaatgattac attattctgg aagttgaacc
3061 acccttcggt gacagcaaaa ttgagattgg aacaggaaca acaaaactcg ttgaagcatg
3121 gcatcgaaaa ggtagctcga taggaaatgc ctttacggcc acttacaagg gcatcacaaa
3181 attgacagtg cttggagaac atgcctggga ttttaattca ctaggtgggt ttggagcaag
3241 ccttgggaag gcggtccata cactgtttgg aggtgtattc cgggtgatgt tcggaggcat
3301 gggatggtta accaagatct ttgtgggtgc tgtcctagtc tggctaggat taggagctca
3361 tgacaagacg atcgccacca ccatgatcct ggtaggatcc atactgatgt acatggcagt
3421 gaccgtgggt gccctatcgg aaataggatg cagtctggac attagccgaa aagaaatgaa
3481 gtgtggggac ggagtcttca tcttcagaga ggcaggcatg tggaaggatg ggtatgcgtt
3541 ccacccttcc gaacccaaat ctctggccgc gtcagttctc aagagttggc agtctggagt
3601 gtgcggcgtg cgctccacga acagaatgga acatgccatg tggaaacaga ttgaaaatga
3661 attgaacggc attctagaag agaatgaggc gcaactcagc gtggttgtgc gagagtctaa
3721 cgggaccttc ccgagaggag agcgccgcat gcacgtggcc gaacctctgc gctatggatg
3781 gaagacctgg ggaaagaccg caatttcgac ggtgccgctc gctaaagaaa cgtttgtggt
3841 agatggcaat gatgaaggag aatgtccctc tcaaatgcgt gcttggaatt ccttccaagt
3901 tgaagagttc ggaactgggc tggtgaaaac caaagtgttc ttggacatat ccactgctct
3961 caccgcccaa tgtgacacca aaatgctggg cgctgccata aaggggaata ggtctgttca
4021 tggagatcca ggtctctgga tggtctcagc tgaaatcgat gggacatggc agataataga
4081 gctcacattg gcagagagca ggcgttgcac atggccagac tctcacaccg tgtggggtag
4141 gaatgtccag gagagtgagt tgatactgcc accgtctttc ggaggaccga tgaccaacat
4201 gaacaagcgt aaaggctacg cgacccaagt gggaggacca tggaaccatg ttccactacg
4261 agtagttttt gaagagtgtc cgggaaccac tgtatctgtt gaaccaaact gcaccaggag
4321 atcggattca gtgcgatcca caactgatag cggcaagatt ataaccgact ggtgttgtcg
4381 ttcctgtaca atgcctcccc taacgtaccg aaccccgat ggatgctggt atgcaatgga
4441 aatcaggccc aagaatgtta aagaggagag tctgatccgt tcgcatgtgg cggcaggtgt
4501 gtttaaaggc attgacgacg tgtcactggg gctgttagta atgataattt tcctgcagga
4561 aggtttgaga agaaagttaa ctgcaacgta tatcatgtgg gctgctcttg tggtcctcat
4621 tgcaggaatc ctaggggaac tcacagtgag ggatgtgctc aggtatctca tcctagtcgg
4681 cactgcattc gctgagagta ataatggagg agatttaata catctggccc tagtggcggt
4741 cttcaagatt aggccggcat tcttatttgg attcttgttc aggagtcagt ggtcccccag
4801 agaaggtgtg ttgctggcat ctggagcgct gatgctgcag attgcaagtg agtgcttgca
4861 cgcatcggcg attatgcagg ttgtcgattc cttgagcatg gggtggttga tgatcagagc
4921 cattgctgta cctggtatga cctcaaaagc catgccactg ctgtgtgcct gcattcctgc
4981 agttacgagc ctactggccc actcaaccag agccggtata atcaccatgg ccggcatgtc
5041 gcttattgca ggaagtaagg gatcatcagt taaaaaacac agtccataca tgcttgccct
5101 cgtggtggca ggcctcggag cccgtcccat aggaatgttg gcgatggaag ccttctctca
5161 cctgaagggc cggagatcat ggccggctgg tgagatgatg tcagccgttg ggctgacatg
5221 tgcgctagtg ggagctatca gtggcgcatc atctcaggac ttcgccggac ctctagcagc
5281 agcggctcta attattattg catatgccat tagtggacgc tcagctgatg tataccttga
5341 gaaagccggt gagatatcct ggagtgagga cgctaaaata tccggatcaa gcccgcgcat
5401 tgatgtgtgc gttaccgaaa atggagattt caattgcgt catgagagtg aagcaacctg
5461 gacccggaat tgtgtcttgg ctgcttgctt agtcgtagcc ggagtgcacc cactggggat
5521 tccagtagca gggttgatgt ggtttggata tgtgaaatca aacaagcggg ggactgtgtt
5581 gtgggacatt ccctcaccac aggcaacatc agctccaacg gtggaagatg gatgctaccg
5641 cgttatgtca cgtagactgc ttggcagcac tcagcttggt gttgggatca tgctagactc
5701 tacatttcac acaatgtggc ataaacccg aggagcatct attgttagtg gtgaagggcg
5761 tcttgaccca tattgggctg acgttaagga agacctggtc tgttacggag ggccatggaa
5821 aatccgcaac acatgggatg gactctcaga agttcagctg atagcggtgg ccccaaaaga
5881 gaatcccgtg aacgtccaaa caatgccagg aaagttcatt gtggcgaatg gaggtgagat
5941 aggagccgtt gtgctcgact atcctcctgg aacttctggt tcacccatcg tggatcagca
6001 gggtaatgtc ataggactgt atggcaacgg ggttatgatc aatgaccaaa cgtatgcgag
```

FIG. 72 cont.

```
6061 tgccattgcg caagctccag ctgaagttgc gcgcacccca acctggttca ctgatgatat
6121 gttgcgaaag ggacaattgc atgtgctaga cttgcaccct ggagcgggaa aaacccgcaa
6181 ggtcctgcct gagattctca aagcagcggt ggagaaacgg ctacgcacgt tggtcctggc
6241 cccaaccaga gttgtggcaa aggaaatgca tgaagcattg accgggctgc cggtacgcta
6301 ccagacatca gcagtggcac caaatggttc tggaggagaa ttgattgatg tcatgtgcca
6361 tgcaacatac acacaccgcc agctgacacc gggacggggg gtcaactacc agttatacat
6421 agtggatgag gcacatttta cagatcccgc ttccatcgca gctcgcggca tcattgcgac
6481 tagggtgcga ttgggacatg ccgcagcaat cttcatgacg gccacacccc cgggaatgtc
6541 aaacccattc ccggagtcta atgctcacat tgaagacgaa gagcgggagg tacccaccaa
6601 agcttggaac gctggatatg agtggataac agactatggg ggaaaaaccg tgtggttcgt
6661 gccttccatc cggatggcga acaccatagc tgcatgcttg gtacgagcag gcaagacagt
6721 cattgtactg cacagtggct ctttcaatga agaatatcaa aaaaccaagt ctggcaattg
6781 ggatttcgtt gtgacgaccg acatctcaga aatgggggcc aatttcaaag cctctagggt
6841 catagactct agactgtcca taaaaccgat gttttcctac gctcccagtg agcgagtggt
6901 tattggctca cctagagcgg tttctccagc cagcgcagca cagcgccgag ggagagtcgg
6961 gagagaccct cgtcaactgg gcgaccagta tatctatggt ggaccagtag gagaagactc
7021 ggccgagttc gttcattgga aggaagcaag gatcctcatg gataatgtaa ctgtccctgg
7081 gggcttgtat ccacaattct acgaaccaga gggtggaatg tgtgacgcca tggatggagc
7141 tcaccgactg accgatgcta agagagaagt gttccgagac ctcatgaaga aggggaact
7201 tcctgtatgg ttagcatacc aggtggccca ggctgggcat gcgtacactg acagaacttg
7261 gtgctatggg gggccggcgg atcatcaagt gtatgatgat tgcggccaaa ccgtggatta
7321 caggtccctt aatggagaga ggcgtatgct acgtcccaag tggcttgatc agcgcaccta
7381 caacgacaaa acatccttaa ggctcttcac ggaatttgca gagggacgcc gccgatattc
7441 ggaactaatg gacgtgtttg aagaatgcc ccaacacatg ttggacagga ccatcttggc
7501 tgcagacacg tttaaagatg tcctgacagc aacaccggga tctcgtgtgc accgtttagc
7561 actggacaat ttacccgaag ctacagaaac tatgatggta gtgggaatcc tgagtgtctc
7621 gaccctaggc gttatgctat ttctgatgtc acccaagggc atgacccgga tgacctgcgg
7681 acttgtggtg atcatcctgg cgacgtattt tctatgggtg tcaggaatgg ccggctacca
7741 gatagcagca atgcaactca tcgcgttcat tctgttttgtg gtcttggtgc cagagccagg
7801 gtcacagaga tcagtgcaag acaacaccat agcgataatt ctcatagtca tcctgtcgtt
7861 ggctgccatc atagccgcca atgaagcagg attgctagag aagaccaaaa aggatttcgc
7921 gtggaagagg gagagtcatg tgctggtgac tccgagtccg tggaacctgg atttctcaat
7981 ggatttgagg ccagccacca gctggtcatt gtatgtggtg atggccacca tgttagggcc
8041 agtactggaa cacgccattg tcaccaatta tgctagcgtc tcacttactg ccatcacaaa
8101 ccaggcagga atactgctgt caatggataa gggcactcct ttctggaatc ttgactggag
8161 tgttgtcctg ttgtgcgtgg gcagctggtc ggggatcaat ggcactacac taatggttgc
8221 ttccacaatg acagttttgc attttgccat gatactacct ggcattcgtg ccaaagcggc
8281 gagagaagca cagaatcgaa cagcagctgg ggtgtcaaag aaccctctta ttgatgggtt
8341 aaacaccata aacatccagc cgttgccgga aatggacccc atgtacgaaa ggaaaatggg
8401 gctatggatg ctaatcgctg ttgccggagc cgcggtggtt tttgacaaga gaatgctcca
8461 ttacaccgag ttcggagtat tgggttcagc tgctgtgagt cctctcattg aaggatacgc
8521 gtctgctgtt tggaacactt ccgtagcagc cagtgtgtgc aacctaatgc gaggccatta
8581 catggcggga atcccaatgg catactctct gatcagaaat ctatccatga aggagttcc
8641 taggaggga ttacaggcca cccatacccct tggtatggtt tggaaacaca aattaaacgc
8701 catggacaag gcggcccttta acgcataccg gaaggatgga gtgacagaag tggatagga
8761 gccagcacgt gaagctatga agaaggaga tttggtgagc ggatgggcgg tctctcgagg
8821 gtcagccaag ctgcgatgga tgcacgagcg tggatacatt cccctacaag gagttgtcat
8881 tgacctcgga tgtggaagag ggggtggag ttactacgct gctgcacaac gccgggtgac
8941 cgctgtcaaa gggctcacga aaggcggacc agggcatgag gagccaatca acgtccagtc
9001 atatggatgg aacttagtga cgttccgtag tggagtggat gtctttcaca ccgaagtcca
9061 gccggctgac accctgttgt gcgacatagg agagtcttct gctgaccccg ctgtcgaaaa
```

FIG. 72 cont.

9121 agcgcgcaca gtacaagtgt tggtgaactt tgaaagatgg attagagagt cgcggtgtga
9181 gcatttttgt tgcaaggtgc ttggtcccta ctctcccgaa gtgatggagc gcttagatcg
9241 tttaacaaag acatatggag gagcggtaat tcgcaaccca ctatccagga actccacgca
9301 tgagatgtac tgggtgtcag gagctaaggg taatccagtc aatgctataa cagccacctc
9361 acgtgtgcta atcgaacgca tgtacagaag acttggcaag agttactggg aagaagatgt
9421 gaatcttggt actgggaccc gtgcagtttc atgtccgcg gagaagccag atctagcaaa
9481 aatcggaagg cgcattgagt tgctgaagaa ggagtataaa gcatcatggt tcgaggatcc
9541 agagcatccc tacaagacat ggacatacca tggttcctac gaaaccaaga ccacaggcag
9601 ctcgtctagt atgattaatg gcgttgtcaa ggagatcact caccccttggg ataccaaccc
9661 aagggttaca accgtctgta tgaccgacac cactcctttt ggacagcaga gagtattcaa
9721 ggaaaaggta gataccaagg cacgtgagcc atctcaaggg acgcgggaga tcatgagaat
9781 agtgagcaag tggctcacac tatatattgg tcggagcaag cgccctaggc tgtgcacagc
9841 ggatgaattc atagccaaag ttaatgctga tgccgctctc ggcacgatgt tcgactcgca
9901 gggaaactgg gcgaacgcca aagaagctgt gcgcgaccca cggttttggc agttggtggc
9961 caaagagagg gaacttcacc tgcgtggaca gtgtgccacg tgtgtttaca acatgatggg
10021 gaagcgagag aaaaagctga cagagtttgg gaagtcgaag gggagccgag caatttggtt
10081 tatgtggcta ggagctaggt tcttggagtt tgaaagttta ggcttcctaa acgaggatca
10141 ttggttgtca cgtgaaaact caggaggtgg agttgagggc attggattgc aataccttgg
10201 gtatgtgttg aaagaaatgg cactaattcc cggggggcaag atgtacgccg atgacaccgc
10261 tgggtgggac accagaatta ctaacgctga ccttgaggat gagatggaca tattgggact
10321 tatggacccg catcacaaaa aactggcaaa aaatctgatg gagttggcgt acaacaacaa
10381 ggtggtcaga gtgatgcgcc ctggtaaagg gggaaaaaca ctaatggaca tcattagccg
10441 caaggaccag cggggaagtg gacaagtggt cacctaccca ctcaacacgt ggacgaatct
10501 caaggtccaa ttgatccgta tggcagagtc agagggagtg ttggaccccca aggagatcga
10561 tggaatcact gtcacgactc ggaataacct ggaaaaatgg ctcactagcc aaggggctga
10621 gcgtctaaag cgcattgcag ctagcggtga cgacgttgtg gtaaaaccag tggatgagag
10681 attcgccaat gctctcacct atctaaacga catggccaaa attaggaagg acatcagtga
10741 gtggaaacca tccgcggggt ggttccactg ggaagaagtg ccattctgct cacaccattt
10801 tcaccagttg gtcctcaagg atgggcgcac cttagtggtc ccatgccgtg accaggatga
10861 actaattgga agggcaagag tgtcacctgg tgctggatgg actatcagag aaactgcagg
10921 tctaagcaag gcctatgccc agatgtggct tctaatgcac ttccaccgga gggacctcag
10981 aatggcaggt ttcgccattt gtagtgctgt ccccagtgat tgggtgccca cgggaaggac
11041 atcgtggtca ctgcacgcta aaggggagtg gatgaccact gaagacatgt tagcagtttg
11101 gaacagagtg tggattgaag acaatccccca catgtctaac aagactttag tgggatcatg
11161 gcaagacatc ccgtaccaga ggaaatccct ggacatccac tgtggctcaa tgataggggca
11221 gcggtctagg tcaacatggg ctgctaacat acgaattagc attggacacg tgcgccgatt
11281 gattggaacc acggaaaagt acttggatta catgcaggag caggagcggt tcaagattgc
11341 tgaaccaacc cgtctgggca atgtgatcta aggatctacg aacgagaata agtagaagaa
11401 cggaacgaca gagtcaggcc tcaaatgagc cagcattaat gagagtaagt gctgctgcct
11461 gtgcctctcc ttaacacgtg gtagcgccac tcgtgtttcg ttacctaata gcgctagagt
11521 cagacccaag taggccaggg ctatggttgt aagccctgct gtctgtggca gccatccagt
11581 ggtaatgcgt cgcaccacta aggattaata gacgtatatt ggggagggact ggtgaggagc
11641 agcaagctcg agctgcatca cccactggta ctatcggtta gaggaaaccc cctccaaaat
11701 gtagagcatc atatcgacac ctgggaaaga ccggagatac ctcttgcttc acagcactca
11761 atccacaagg cacagatcgc cgaataattg tggattgggg attgagaaac atcaagtatc
11821 t

SEQ ID NO:397          BinJV$_{V106G}$ ORF amino acid sequence

MSKKPGGPGKSRAVNMLKRGMPRVLSLIGLKRAMLSLIDGKGPI
RFVLALLAFFRFTAIAPTRAVLDRWRGVNKQTAMKHLLSFKKELGTLTSAINRRSSKQ
KKRGGKTGIAVMIGLIASVGAVTLSNFQGKVMMTVNATDVTDVITIPTAAGKNLCIVR
AMDVGYMCDDTITYECPVLSAGNDPEDIDCWCTKSAVYVRYGRCTKTRHSRRSRRSLT
VQTHGESTLANKKGAWMDSTKATRYLVKTESWILRNPGYALVAAVIGWMLGSNTMQRV
VFVVLLLLVAPAYSFNCLGMSNRDFLEGVSGATWVDLVLEGDSCVTIMSKDKPTIDVK
MMNMEAANLAEVRSYCYLATVSDLSTKAACPTMGEAHNDKRADPAFVCRQGVVDRGWG
NGCGLFGKGSIDTCAKFACSTKAIGRTILKENIKYEVAIFVHGPTTVESHGNYSTQVG
ATQAGRLSITPAAPSYTLKLGEYGEVTVDCEPRSGIDTNAYYVMTVGTKTFLVHREWF
MDLNLPWSSAGSTVWRNRETLMEFEEPHATKQSVIALGSQEGALHQALAGAIPVEFSS
NTVKLTSGHLKCRVKMEKLQLKGTTYGVCSKAFKFLGTPADTGHGTVVLELQYTGTDG
PCKVPISSVASLNDLTPVGRLVTVNPFVSVATANAKVLIELEPPFGDSYIVVGRGEQQ
INHHWHKSGSSIGKAFTTTLKGAQRLAALGDTAWDFGSVGGVFTSVGKAVHQVFGGAF
RSLFGGMSWITQGLLGALLLWMGINARDRSIALTFLAVGGVLLFLSVNVHADTGCAID
ISRQELRCGSGVFIHNDVEAWMDRYKYYPETPQGLAKIIQKAHKEGVCGLRSVSRLEH
QMWEAVKDELNTLLKENGVDLSVVVEKQEGMYKSAPKRLTATTEKLEIGWKAWGKSIL
FAPELANNTFVVDGPETKECPTQNRAWNSLEVEDFGFGLTSTRMFLKVRESNTTECDS
KIIGTAVKNNLAIHSDLSYWIESRLNDTWKLERAVLGEVKSCTWPETHTLWGDGILES
DLIIPVTLAGPRSNHNRRPGYKTQNQGPWDEGRVEIDFDYCPGTTVTLSESCGHRGPA
TRTTTESGKLITDWCCRSCTLPPLRYQTDSGCWYGMEIRPQRHDEKTLVQSQVNAYNA
DMIDPFQLGLLVVFLATQEVLRKRWTAKISMPAILIALLVLVFGGITYTDVLRYVILV
GAAFAESNSGGDVVHLALMATFKIQPVFMVASFLKARWTNQENILLMLAAVFFQMAYH
DARQILLWEIPDVLNSLAVAWMILRAITFTTTSNVVVPLLALLTPGLRCLNLDVYRIL
LLMVGIGSLIREKRSAAAKKKGASLLCLALASTGLFNPMILAAGLIACDPNRKRGWPA
TEVMTAVGLMFAIVGGLAELDIDSMAIPMTIAGLMFAAFVISGKSTDMWIERTADISW
ESDAEITGSSERVDVRLDDDGNFQLMNDPGAPWKIWMLRMVCLAISAYTPWAILPSVV
GFWITLQYTKRGGVLWDTPSPKEYKKGDTTTGVYRIMTRGLLGSYQAGAGVMVEGVFH
TLWHTTKGAALMSGEGRLDPYWGSVKEDRLCYGGPWKLQHKWNGQDEVQMIVVEPGKN
VKNVQTKPGVFKTPEGEIGAVTLDFPTGTSGSPIVDKNGDVIGLYGNGVIMPNGSYIS
AIVQGERMDEPIPAGFEPEMLRKKQITVLDLHPGAGKTRRILPQIIKEAINRRLRTAV
LAPTRVVAAEMAEALRGLPIRYQTSAVPREHNGNEIVDVMCHATLTHRLMSPHRVPNY
NLFVMDEAHFTDPASIAARGYISTKVELGEAAAIFMTATPPGTSDPFPESNSPISDLQ
TEIPDRAWNSGYEWITEYTGKTVWFVPSVKMGNEIALCLQRAGKKVVQLNRKSYETEY
PKCKNDDWDFVITTDISEMGANFKASRVIDSRKSVKPTIITEGEGRVILGEPSAVTAA
SAAQRRGRIGRNPSQVGDEYCYGGHTNEDDSNFAHWTEARIMLDNINMPNGLIAQFYQ
PEREKVYTMDGEYRLRGEERKNFLELLRTADLPVWLAYKVAAAGVSYHDRRWCFDGPR
TNTILEDNNEVEVITKLGERKILRPRWIDARVYSDHQALKAFKDFASGKRSQIGLIEV
LGKMPEHFMGKTWEALDTMYVVATAEKGGRAHRMALEELPDALQTIALIALLSVMTMG
VFFLLMQRKGIGKIGLGGAVLGVATFFCWMAEVPGTKIAGMLLLSLLLMIVLIPEPEK
QRSQTDNQLAVFLICVMTLVSAVAANEMGWLDKTKSDISSLFGQRIEVKENFSMGEFL
LDLRPATAWSLYAVTTAVLTPLLKHLITSDYINTSLTSINVQASALFTLARGFPFVDV
GVSALLLAAGCWGQVTLTVTVTAATLLFCHYAYMVPWQAEAMRSAQRRTAAGIMKNA
VVDGIVATDVPELERTTPIMQKKVGQIMLILVSLAAVVVNPSVKTVREAGILITAAAV
TLWENGASSVWNATTAIGLCHIMRGGWLSCLSITWTLIKNMEKPGLKRGGAKGRTLGE
VWKERLNQMTKEEFTRYRKEAIIEVDRSAAKHARKEGNVTGGHPVSRGTAKLRWLVER
RFLEPVGKVIDLGCGRGGWCYYMATQKRVQEVRGYTKGGPGHEEPQLVQSYGWNIVTM
KSGVDVFYRPSECCDTLLCDIGESSSSAEVEEHRTIRVLEMVEDWLHRGPREFCVKVL
CPYMPKVIEKMELLQRRYGGGLVRNPLSRNSTHEMYWVSRASGNVVHSVNMTSQVLLG
RMEKRTWKGPQYEEDVNLGSGTRAVGKPLLNSDTSKIKNRIERLRREYSSTWHHDENH
PYRTWNYHGSYDVKPTGSASSLVNGVVRLLSKPWDTITNVTTMAMTDTTPFGQQRVFK
EKVDTKAPEPPEGVKYVLNETTNWLWAFLAREKRPRMCSREEFIRKVNSNAALGAMFE
EQNQWRSAREAVEDPKFWEMVDEEREAHLRGECHTCIYNMMGKREKKPGEFGKAKGSR
AIWFMWLGARFLEFEALGFLNEDHWLGRKNSGGGVEGLGLQKLGYILREVGTRPGGKI
YADDTAGWDTRITRADLENEAKVLELLDGEHRRLARAIIELTYRHKVVKVMRPAADGR
TVMDVISREDQRGSGQVVTYALNTFTNLAVQLVRMMEGEGVIGPDDVEKLTKGKGPKV
RTWLFENGEERLSRMAVSGDDCVVKPLDDRFATSLHFLNAMSKVRKDIQEWKPSTGWY
DWQQVPFCSNHFTELIMKDGRTLVVPCRGQDELVGRARISPGAGWNVRDTACLAKSYA
QMWLLLYFHRRDLRLMANAICSAVPVNWVPTGRTTWSIHAGGEWMTTEDMLEVWNRVW
IEENEWMEDKTPVEKWSDVPYSGKREDIWCGSLIGTRARATWAENIQVAINQVRAIIG
DEKYVDYMSSLKRYEDTTLVEDTVL

FIG. 73

|       | BinJV | LLCFV | BJV  | CHAOV | DONV | ILOV | LAMV | NHUV | NOUV |
|-------|-------|-------|------|-------|------|------|------|------|------|
| BinJV |       | 76.3  | 53   | 62.4  | 59.5 | 59.8 | 62.2 | 52.5 | 52.1 |
| LLCFV | 90.8  |       | 53.1 | 62.7  | 59.4 | 60.4 | 62.5 | 52.6 | 52.5 |
| BJV   | 48.1  | 47.8  |      | 53.5  | 53.2 | 53   | 53.3 | 65.8 | 56   |
| CHAOV | 64.7  | 64.1  | 48.4 |       | 61.9 | 62.9 | 74   | 53.3 | 53   |
| DONV  | 11.9  | 11.6  | 11.5 | 11.6  |      | 65   | 62.2 | 53   | 51.9 |
| ILOV  | 60.6  | 60.3  | 47.7 | 64.8  | 11.9 |      | 61.9 | 52.1 | 51.9 |
| LAMV  | 64.3  | 64.1  | 48.3 | 85.5  | 11.4 | 64.2 |      | 53.4 | 53   |
| NHUV  | 46.7  | 46.9  | 71   | 48    | 11.6 | 47.3 | 47.6 |      | 55.9 |
| NOUV  | 46    | 46.2  | 53.1 | 46.9  | 10.4 | 45.5 | 46.6 | 53   |      |

FIG. 74

|       | PaRV | CFAV | CxFV | QBV  | PCV  | HANKV | AEFV | KRV  | CTFV | NIEV | NAKV |
|-------|------|------|------|------|------|-------|------|------|------|------|------|
| PaRV  |      | 43.5 | 40.9 | 39.6 | 39.8 | 72.0  | 41.0 | 42.1 | 40.1 | 40.6 | 39.9 |
| CFAV  | 49.1 |      | 45.4 | 46.1 | 42.9 | 42.7  | 60.1 | 65.6 | 47.1 | 42.9 | 41.5 |
| CxFV  | 47.7 | 51.2 |      | 69.2 | 54.2 | 40.1  | 38.1 | 38.8 | 70.2 | 54.0 | 52.3 |
| QBV   | 47.2 | 51.2 | 65.6 |      | 54.9 | 40.0  | 38.9 | 38.5 | 72.8 | 53.6 | 52.7 |
| PCV   | 47.3 | 48.7 | 55.6 | 56.2 |      | 40.2  | 38.9 | 39.2 | 53.9 | 56.8 |      |
| HANKV | 65.9 | 48.8 | 47.2 | 47.5 | 47.4 |       | 40.7 | 41.3 | 39.8 | 40.4 | 40.4 |
| AEFV  | 47.8 | 59.1 | 46.4 | 45.7 | 46.6 | 47.3  |      | 68.6 | 38.2 | 38.6 | 38.8 |
| KRV   | 48.4 | 62.6 | 47.0 | 46.9 | 46.6 | 47.8  | 63.8 |      | 38.9 | 39.6 | 39.5 |
| CTFV  | 46.9 | 51.9 | 66.4 | 67.4 | 55.7 | 47.3  | 46.2 | 47.1 |      | 53.0 | 51.9 |
| NIEV  | 47.6 | 49.0 | 56.1 | 56.1 | 57.3 | 47.5  | 45.8 | 46.8 | 56.2 |      | 55.7 |
| NAKV  | 46.8 | 48.5 | 54.8 | 54.9 |      | 47.2  | 45.8 | 46.6 | 54.9 | 56.1 |      |

| Cell Line | | LiCV Replication |
|---|---|---|
| Monkey | Vero | Negative |
| Hamster | BSR | Negative |
| Mosquito – *Anopheles* | MOS55 | Positive |
| Mosquito – *Albopictus* | C6/36 | Positive |

| Cell Line Tested | | Virus Replication | |
|---|---|---|---|
| | | BinJV | WNV$_{KUN}$ |
| Mammalian origin | Vero (monkey) | - | + |
| | BSR (hamster) | - | + |
| | MEF WT (mouse, wild-type) | - | + |
| | MEF IFNAR$^{-/-}$ (mouse, interferon knockout) | - | + |
| | OK (marsupial, opossum) | - | + |
| | SW-13 (human) | - | + |
| Avian origin | DF-1 (chicken) | - | + |
| *Culex* origin | Chao Ball | + | + |
| | HSU | + | + |
| *Anopheles* origin | mos55 | + | + |
| *Drosophila* origin | S2 | - | + |
| *Aedes* origin | RML-12 (RNAi-competent) | + | + |
| | C6/36 (RNAi-deficient) | + | + |

FIG. 80

BinJV-DENV$_{prME}$ BinJV-ZIKVprME

Anti-VIF E

Anti-BinJV E

*P0, P1: PCV/KRBV-prME*

FIG. 92

>SEQ ID NO:398 PaRV/KRBV-prM

GCCCGGTACCTTGAAGCTGTCCCTGATGGTCGTCATCTACCTGCCTGGACAGCAT
GGCCTGCAACGCGGGCATCCCGATGCCGCCGGAAGCGAGAAGAATCATAATGGG
GAAGGCCATCCAGCCTCGCGTCGGCGCTTAAGACATTGATTATTGACTAGTTATT
AATAGTAATCAATTACGGGGTCATTAGTTCATAGCCCATATATGGAGTTCCGCGT
TACATAACTTACGGTAAATGGCCCGCCTGGCTGACCGCCCAACGACCCCCGCCCA
TTGACGTCAATAATGACGTATGTTCCCATAGTAACGCCAATAGGGACTTTCCATT
GACGTCAATGGGTGGAGTATTTACGGTAAACTGCCCACTTGGCAGTACATCAAGT
GTATCATATGCCAAGTCCGCCCCCTATTGACGTCAATGACGGTAAATGGCCCGCC
TGGCATTATGCCCAGTACATGACCTTACGGGACTTTCCTACTTGGCAGTACATCTA
CGTATTAGTCATCGCTATTACCATGGTGATGCGGTTTTGGCAGTACACCAATGGG
CGTGGATAGCGGTTTGACTCACGGGGATTTCCAAGTCTCCACCCCATTGACGTCA
ATGGGAGTTTGTTTTGGCACCAAAATCAACGGGACTTTCCAAAATGTCGTAACAA
CTGCGATCGCCCGCCCCGTTGACGCAAATGGGCGGTAGGCGTGTACGGTGGGAG
GTCTATATAAGCAGAGCTCGTTTAGTGAACCGAGTTTTAAAAGTTAACCCGTGGT
TTTACCCTAGTTTCGGTGAATTTGCCAATTTTACGGAATAACTGTTTGAAAGGTTC
AAACTCTGGTGTCCAACGTTTGTATTAAAATGAGTGGATTAGGAGGCCTTCTTCC
CCTCCGAGGGAAGAAAAAGAAAGCCCCTGTGATACAATCACAGGGCAGGGTCTT
GCCGAAGAGCGACTGGAAGGGAGCTCCGAAACAGGATCTAAATAAAAAGAAAG
CGAAAAAGGACGAGACGAAAGGCCAGAATTGGCCAAGAAGAATTAACCCCCGG
ACTGGACAATGGTCGGCAATTGAGGGCTCTGGTGCTCGGCTGTGGAGAAGCATTT
TCTCTACAGACTTGATCGGAGGCTTGTTGTTGTTGATCGCTATTTTATCAAATCTC
TACGAAAAGGTTAGACGTGACATAACGGAATTGAAACGCAGAGTGACTCGATTG
GAAAAATCTCGAGCTAGTTTGATTTTGACCCCAATGGTGTTGCTGTGTCTGGCTAT
CCTCGCGGCAGGCAAGACCATGAATGGAATAATGGACAAGGGTGAGCACGTTTG
GAAAGCTGACTGGAATGTTGACTTTACCAATGTGAAGCTCCCCAAGGACTTCTGC
GGATCTGGAATACACGTGGAGAAGATGTGTCCTCAGGTTGATTCTTTGCAAGATG
CAACAATCGACTGCGCAGGAAGACATGACCAATTTCTCCTGTCCTATACACGATG
TGCGGCTAAGAATCGTGTCAAACGTGGTGAACCCGGAGTAGTGGAACCGAAAGT
CACGAACATATGGACCATAACGTTCAATGATGAGTTGAACAGCATCATTGAACGT
GTGAGCGGGATGCTGAAGAACAATCGATTGATGGCAACAGCAGTCATTTGCTTAG
TTGGGGCTTTCAAGAAATGGCCTACATGGCTCGTCGTGCTTTTGGTTTTACTGCCT
TGGACTGTCGTGCAGGCAGAGTTTGTTGAGCCATTCTTGGTTTTAAAACATGACC
ACAGTACTATGCTCATGACCAGACTGTACCCAGGAGAAATCGCTCACGTTGCAAC
TCCTGCCGGGTTGGTGGACATTCGTGTTAGCCATGCCCAAATTTTTGGAGGTCAA
CGCTTTCGTGAGTTACTGAGCGACTGCTCTGTGAACGCTTCGTATTCGACCGACAT
ATGCCCCGGAGGATCACAACTTGACTTGGAATCGATCAAAGGTCCTGGACGTGTC
TGCATGACCGCTCCGTACAATCGAGGATGGGGAACCGGATGTTTCAAATGGGGA
ATTGGAGCTGTTGCCACGTGCGTTGAGTTGAACTGCACACGGGAAACAAAAGTTG
ATTTGTTGACAAATTCTGCTATTGTGGCCAACGTGACAGTCAATTTCCACTCGACC
AATGACACTAAACTCCTTGTGCCTGACACCCCAATTACGTTGAAGTTTGGGAAGT
TAGGAACGATGACAATGACGTGTCGTTTGGGAAATGACCGCATTGCTAACGATTT
TTACCATGTAACTGACAATATTGCATCTGGACTGTTCCAGAAAGCTTTGATTGATG
CGTGGGAAGGACCCTCCAAGATGGCGAACCACATTAGCGGACATGAAAAAGTCG
TGAAGTGGGGTCACATTCTCCCAAATGAGATCAAGGTCAGCAAGATCATTGAAAT
GGAGTTAGATTGGGAAAAAGCGATCACCACACATGATGGATTTTCGAACACCTAT
TTTTGGTGTCAAGTGGCCGTGAACAAGTTGGTCGTTGGGTCATTTGCCTCATGCAA
GAGCGGAGCGAAGGCTAGCTTCATCCAATCCTCGTGGGGTTTTGATGGTGTGGTT

FIG. 94

```
GAAGTGACTTTGGATGAGGCCACCAAAACCATTTGCTCCCTACCCCTGACATGTA
CCGGATGTAGCTTGTTGGCTACAAAAGTGGTTTTCCTTGAGGGAAGCCAGCGGGC
TGTTGGGCACGTGGGGTGTGGAAATGGAACATCAATGTTGACAGTAGGAACGAC
AAAGGTTGGGATCCAATGTGTGGTCACACCGGTGTCACAAATTTGGAACTTCGTG
ACTCACGCTTCCGGACGATATGCGAAACTTGGTTTTGGAGGAGTTGGAGGAGCTT
TCCATGATCTGCTAGTGAAGGTTGGATTGACCTTCACCTGGGATTCATGGAAGAT
CATCACCGTGTTGTCTGGTCTCGTAGTGGCTTTTGCCATCTTTGATCGGAAGTTGG
TGATCCTGATCATTATCCTCTGTGGAATCGCTTATACCCGAGCTGACATTGGATGT
GGCATTGATTTTGACAGGAAGACCTACACGTGTGGAAGCGGTCTATTCGTGTGGA
AGGGTTTGGGAAAATACCCAACGGCCGACCATTCTGTTGAGTTTGCCTCATATGA
TTTTCTATCAGCGTACCTCCAGGAGCAGTTTAAGTCTGAGAAGAAGGTTTGTATT
ATTTGTGAAGACATTGTCCAGTGTGAGGCAGCTAGAAAAGCAGCCGCTGCGGTGT
ATAAAAACCTAGGCCACCCGTTTGTCTACGTGAACACGTCGGACTCCTATGGAAA
AGTATTTGCCGAAATCCCGAAAAGAGTCCACACTGTTAGTGTGGGAGTCGACGTT
GTGGAAATGGCCATGATGACTAGGGAGAACAAACCGGTTGGACCGTTTGGTGAC
TTACCGCGTAGTATGGTTTCGTGGAAGAGTATCCCTGAAACAGAAGAGCACCCAG
TGTTGAGAGTGTTGACATCTTCAAGTGATTACCAGAAGGTATGTGGAAAAGCGAT
TGGATTCCAGTATGATTTTGTTGGATACCGTCGGACCATGTATGGATCTAATGTCC
AGTTAAAAATATCAAAGAAGGTTTCGATTGAATGTCCCACATACTTGGCAGGAGT
CGCCGTGAAAAATGATAGAACGGTTTTCACTGATGGAATGTTCTGGATGTCATCG
AAACGTGAGAATGGAACATACGCGATCACTGAGTTAGAGATGGAGCAGTCCCAC
AAGTGCATCTGGCCAGACCAATACACTCCTGACGCCACTTTGACGCCACGTGACA
ATGAAATGTTTGTTCCGCCTGAGTGGGGAGGGCCAATGTCGAAAGCCAACCACAT
TCCTGGTTACAAAATGCAGACTGGATTTCCATGGAACAAAGCCCCCATTCGGTTT
GTTGAGGGAAGTGTTCCAGGAACCATTGTCACACAGATTAGCCACTGTGATGGTA
GAGGGATTGCAGCCGAAGTGAATCCAGCAACGCAGCCCAATTGGTGCTGTAAGT
CCTGTACAAGGATTTTCCACTTTGAAGTCGATGGGAAACTCTATTATCCAATGGA
GATTCGGCCCGACCCGAAAGGAGGGGAACAGCAAAAAGTTCCTGTAGTGGAGAC
ACCCATTGGAGATGAAGAAACCGAGACTGTTGGTGGATGGCTGGGTAGAATGTA
TAACATTCCAGGAGCTGAGGGATCATATGCGGATTTTCGACTCCCCAAGTTGCCA
AATTCAAGACCAAGCGCAATGGTGGGGAGTTTGGTCAATCTATTATGCTTGATGT
TTTCAATTCAGATAGTTACCAAGACTATGCGGGCAAGAACGCTTATGCGTTTCTA
TCTTTGTTGCTTGGTTTTTATGTTCTTTGGAATGCCAACTTTGTTTGGATTAAGTGG
GTTTTTGGCGTGGATGATGATTCTACCAATCTCACACAACTCGGTAACAATGTGC
AACCTAACCGTGCATCTGTGGGCTGTACTGCTAAACCAGAGCTCGGCGATGTTTC
TGTGGGGCCTAACGCTCCGATCCCAGATACAGAGGTCTACCGCTGGACAGATGCT
ACTCTTTACCATGCAGATGTTGCATCACGCCATCTACGCGCACTCTTGGGTGTTCG
GGTGGGTCATCGAAGTATGCTTGTCAGTCGGGCTTATGATGAACTTGTTAACCGT
CATCGATACGGTTCACCCGAAACTGATCGCATACTTGCTCTTCTTCGGATGGAAA
ACGGGCATGTGCGTAGTGTGCGCTTGGTTATTGATATACTCAATCAGGAGATGGA
ACTCTATAGTCGCCGCGGCTCCGGCCGCGGGCGGGTGGAGGTCAGGGTATCGAA
CAATGATGTCCTCCAGTTTGATTGTTATCTTTATCAGTGTAGGAATTGCAGGAGTT
ATCGCTTCGGACTATGGAGGTTATCCGGCTGCGGCTGCGGTGACTGCAGCATTGT
TGATAATGGGAATCAAATGTTTGACTTTCTGACGACCCGATTGTCTCTTGAGTTC
GTATCTGCAGGCATGTTCCCCGAAGGTGTTGAAAAAGCCTTTGAACCGGACTCGG
TCAGTGACTTGTTTAGGGCATCTTTCACTGTAGATGGGATAAAGTTGCAGGACCA
TGTTGAACCGATCCCCATTTTGTTTGCCATTTTGTACATCTTTATTGGAGCTGTGG
CCTGTAAGGTTAACCCGGCCCTCGGAATAGTGTATGCTATCGCCATGTTCGCGAC
TCCTTTAC
```

FIG. 94 cont.

```
CGGAGTTAATGCGTTTATACATGATGACCATCTATTCCTCTACATTTCGGACAGAC
ACTCTGCTTGGGATGGCTATCCCAGAAACGGAGCCAGAACTGTCTCAAGACTTTG
GGCCAATCCCTGATGGGATTTATCGGGTGAACAATCATGGATTTTCAGTGAAGAG
TCATCGGGGAGTTGGAATCGTAAAGAATGGGGTTTTTCACACTCTCATGCATGTC
ACGCTCAATGAGCCACTCGCGTGGCAAAATCGCCTAGTAGGACCTTCAATGGGCC
ACTCTCTCAAGGACTATGTCACATACGGTGGAAACTGGCAATTGCCTGACTTTGA
TATTGTTAATGAGGTGGGCATAATGGTTTGTGGACGGGATCGTTCCATTCAGTAC
AAAAGACACGAGGTTGGGACAATCATGATCGACGACAAGCGAGTGATGTACTTC
ACTCATGATTACGGGCACGGATCATCTGGTTCACCAATTTTTGTGAACGGAGAAC
CTGTGGCCTTATACGGCTTCGGGTTCCATTTGTACAATAGGTATCGATCAATAGTT
CTGCCTATCCCACGTGAAGAAGTCCTTGATGGGGCTAGTAATGAGGGCATACCAG
CTGAGCACGGAACCATGCGCAACAAGTTTTTTGTTGACTGGCATCCAGGAAAAGG
GAAAACCCGAAAAGTGATCGTTAAAGAGGTGTTAAATGCTTTGAATTTAGCACGG
CGGATTGTTGTTCTGGCCCCTACACGAGTTGTCCTGGCTGAAATAACTAAGGCAA
TAGGGGAAAACACATCAAAAACGCCCTCAAAAAATCTTGCTTTCACCGGTCACAA
TATTGTGACGGTGGCTTGCCACGCGACGTTCACTGATTATGTTTTGCGTCATGGGT
TATCAAAATTCAAAGCTCACGAAGTCATAATGGATGAGTGCCATTTTCTGGACCC
ACGATCTATAGCTGCGAGAGGAATCCTGGAGCATCTGGCAACTAAACGTGGAGTT
AAAGTCACGTTTATGAGTGCAACGATCCCAGGACGTGAACCTTCACTCGGGTCGA
ATTTTGAGATCTCTGAACAGGCCTTGCAGTTTCCCCGTGACGTCAACCAAAGGTG
GATAGAAACTGTTGCTAGGGGAAAGACCGTTGCCTTCGTGCCATCTCACAGGGTA
GGTGACAAGCTAGCTCGCGGGTGTCCCCAAGCCATTTCCCTGCATAGGAACAATT
TTGACACCAATTACAGCACAGCTATGGATGAGTCCATAAAATTTATCTACACCAC
TGACATATCGGAAATGGGAGCCAATTTCAGTGCTGACACCGTCATAGATTTCCGG
GTGGCGATTAAGCCAAAGATTTCTAGTGAATTTGCCGTCACTCTTGAACCAACTC
CGATCACGCGATCATCGATGATTCAACGGCGTGGTCGAGTTGGAAGACAACGAC
CTGGAACCTATATTTACCCAGTTGACAAAGGCGTCGAAGATGCCTCCGATCAGTT
GGCTTGTTGGACAGAAGCTCAGATGTTGTTGGATCAATTGGACTTGACAATGATG
GCAGAGGAAGTTCGGCAGTCAAACATTCCAGGGGCTTACAAATTAGTTGGGCGT
AGCCTAGACATATTTCGGAAGTTGCTGGAGAAGGATGACATACCAATCTGGCTGA
GCTGGAAGTGGGCCGACAGTGTTCAACAACAATACTCCATATTGTTTGAAGGAGA
ACGTCAAGAGAATGTCGCTCGTGTCGTCAACACTCGAGACTATGCTTCTCTAGAG
TATAAGCCGAAGTTTGTTGATGCACGATTCGAGCGTCTTGGATGGGATCAACGAA
AGCTGTCAATTCAGTTTTACATGAACACTCGGAGCTTCATAACTTTCGCCACTTTG
TCACACGTCATTTCTCAAGTGATCGAAGCTGGAGTTGTCAATTCTGCTTGGAAGC
GAATAGGAGACGTTAGCATCATCTTTACTGAAGGAGGCGACCCACATGCTAAAG
ATGAAACTATCATGGCTTGGACTATTCTGGTTGGAGGAGTGTTGGGGGCTCTTGG
ATTCCTCATAGTTGCATGGGGAATGAAGGCTGTCTTGCGAGTAATTTTCGGATCC
CGCGATAAGCATCTTAGCGTCCCAACCTTAGTGGCGGATTTCCAACCATACATAG
TGTGTATAGTTCCCATTGCCCTACATCTTGCTGGGGTTCCTATACCAATGACAATT
GTGTTTTTCGCGATGCTTTTCTTGACTTATCCACTAATGTACAAGAGTGCCGGACA
ACGGAGTTATGTTGACATTGACTTGGTGAAATGGATTCTGTTAGGTGGATGTATT
GTAACTGGAGTCATTTGCTGGGAAATGAGATTGCTCCCAAACATCTCATCAGACA
TTTCAGCTATTTTGAATAGGCAAAGACAAAGGGAAGACACCCCAACTTTTGATGC
TTCACCACCTTGGGAATGGTTGGATTTAGCACAGCCAGTCCCTCACAATGTTGAA
TTGACGTCAGTGGTGATAACTACATTCACGACCTGGCTGTTCTTGCACCAAATTGT
CGGATGGTCATACGAGTCAGAGTGGCTGAAATCCTATTTCGACCACAAAGGAGTG
GGTCAGATCATGGGTGGTTTTCGGTTGGACACAATTTCATGGGGATCAGCTCTAA
GCGGTCTTCTGGGCACAGCTACTTATGCCTCATGGGGAGCCATTTTGACTGGGTT
AGGAGGAGCGGTTGTGTATTTTTTCCTGATGGTTTCAATGCTCAAGTGGAACTTTT
```

FIG. 94 cont.

```
CGGGAGGAGCCACAACTGGCTTAGAAAACAATGTCATGCGAAACGACCGAGAAA
CTGGACTAGGTAATCGGCCGGCAAACGACAATAGGCGTTCCCTCCTGTACGGTGT
GGTGGCGGCTGAATGTCTTGTGTGGTTGTTCTGTTTCAGAACTGCCACGGATGCC
ATAGTGGTGGCTTGTTTAGTGTCCTATTGTTTATGGATCATCAACAACCCGGCTAG
CCCTCACCACAAAAACACTGACTTAGGATCGGCGTGTAGTTTCATCGGTCTTTTGT
ACTGTACATGTCCTACTCAAAAATGCATCCAAGTATTGATGAGGTTTGCTTTGGCC
AGGTTGAACATGAACACCCGCTCTCTGGAAAAAAGCGCGACGGGAGGCCTTGGA
CACCGTTGGAAGAAGCTATTAAATGCGATGACACTATTGGAATTCAACGCTTACC
GATCTTGTGGAGTTGACGAGACTGAGAAGGGTGACTATGTGTCACGAGGAGGGC
TGAAGCTGAGAGAGATAACCATGAAGTATGGTTGGAAGCCAGAAGGGATATGTG
TTGATCTTGGATGCGGCAGAGGAGGATGGTCACAGCACTTGGCTATGGATCCCCG
CGTAACTAGAGTGGAATCATTCACGTTAGGAGGAACAGCACGAGAAAATCCCCA
GCCAATCAAGACACTTGGTCATAACCTTATCCGGTTCAAGAGTGGAGTCAATGTG
TATAATATGACGCCAACACATGCTAACACCATAGTGTGTGATATCGGAGAAAGTG
ACCCCAAACCAGAGGTGGAAACCTCTAGAACATTGCGGGTCCTCAAAACACTTG
AACTATGGTTGGCCAGGAATCCAAACGCTGAATTTGTGTGCAAAGTCCTTTGCCC
ATACCCCGTGGAAGTCCTCAAATGTCTGGAAACCCTTCAACATAAGTATGGCGGA
AGAATTATTAGGTCGACGTATAGCCGAAATTCAAGTGCTGAAATGTATTACATTT
CTGGAGGCCGTAACAACATGGTGAAGGTTATCTTCACCACCCTCCACTCCTTGAT
TTCGAGGATACGAACTAGGCCGGAGAAAATCGTCAAAGAAAGTGTTTCTCTACCA
GTTGGGACTAGAAGCGATCCAGGGCACAAGATCAAGAGTATGGATCCAAAGATG
ATAGCAACGCGGGTGGAAAAGATAAAAAAGGAACATGCGGACACGTGGTTCGTT
GACAACAACCATCCATACCAATCATTTCGGTATGTGGGATCGTACGTCACAGATG
ATGTGACACCAGGAGGTCAGACTGTCAACCCATTAATGAGAAAAATGATGTGGC
CGTGGGAGACTGTTGGAGGAGTTGTAAATTTCATGATGACGGACGTGTCCACATA
TGCCCAACAGAAGGTGTTGCGAGAGAAGGTCGACACACTATCCCCTGAACCTCCA
AACGACATTCAAAGGGTTAACAGATGGATCACCGAGTTCTTGTGTGCTTCATTCA
TGCGTCGAGGGTTGAAACCTAGAATCCTGACCATGGAGCAATATATCAACAACGT
AAAGAGCTCAGCTGCCATTGGATCGTGGAGCAGTGATGTCCCGTGGAGCAGTGTC
CGAGAAGCTTTAGCTGATAAAAGATTCCACCAAATGGTCGAGGAGGAAAGGAAA
CTCCACTTAGCAGGAGACTGCCGCATGTGCGTGTACAACACCATGGGCAAGAAG
GAGAAGAAACCTTCAGCCATGGGCGTGGCCAAGGGCTCTCGAACCATTTGGTAC
ATGTGGTTAGGTTCACGGTTTTTGGAGTACGAAGCCCTTGGCTTCTTAAATGAAG
ATCATTGGGTGTCACGAGACAACTTGGCATGTGGTGTTGGTGGAGTGGGAGTGAA
TTACTTCGGCTACTACCTACAAGAAATTGCACGGAAAGGGAAGTTTTTTATCGCC
GATGACATAGCGGGATGGGACACGCGGATCAATGAGAGTGACTTGGCCGATGAG
GAATTTCTCATCATGTCCCTCATTTGTGACCCATACCATCGATCACTTGCAAAAGC
CGTGTTTCGGTTTGCCTACCAGAACATTGTGGCCTTGTTTCCGCGAAATCATCCTG
GGTTTGGAAGTGGAACGGTGATGGATGTCGTGGCCAGAACTGACCAACGAGGTT
CAGGACAGGTCGTGACTTACGCTCTAAACACGATAACGAACGCCAAGATTCAATT
AGGCAGAATGCTGGAAGCCGAAGGATTACTAGACGCTCATGAACATGTAATCAA
AAAATGGTTAAACGACAATGGTGAAGAGGCTCTCTCCGGGATGGTGGTGGCCGG
GGATGATGTTGTAGTTGCGACCAACAACGGAAATTTTTCAAGGTCCTTACGATAC
CTCCATTTGAACGGGAAAATTCGTAAAGACATTGATCCGTCCCTACCGTCCAAAG
TTGAAACGAACTGGGAGGTGGTTGAATTTTGTTCTCACCATTACCACGTGATGAC
CTTAAAGGACGGACGACGAATAATTGTCCCATGCCGAGAGCAGAATGAAATCAT
TGGACGAGGCAGGATTCAAAAAGGAGGGTTGGTGACCCTTGCCGAAAGTGCCTG
CCTAGCGAAGGCTTATGGGCAAATGTGGGCTTTGTATTTCTTCACCGAAGAGAT
CTGCGGATGGCTTTTCTAGCCATAACTTCGAGTGTTCCAATAGACTGGTTCCCAGA
GGGCCGGACCTC
```

FIG. 94 cont.

```
GTGGTCGATTCACCAAAATAAAGAGTGGATGACCACTGAGGACATGTTGCGGGT
CTGGAATACAGTGTGGATCCAGGACAATCCCTGGATGGAGGACAAAATGGAAAT
CGAAAATTGGAGGGACATTCCGTACCTCCCGAAATCCATGGACCTAAAGTGCGGC
AGTCTCATTGGAACAAAAGAAAGAGCCGCTTGGTCAAAGGATCTGCCGTCAACG
GTCACGGCAGTTCGGAAAATTATCGACCAAGACACGAAAACCGAGAATGTCTAC
CAAGACTTTCTTGGCGGAATGGGCCGGTTCCAAACGTACACTGACCCCATGGCAA
CGTAAGAAACCATCTTTTCCAAATTAGTCGAAAAATTTTGCCCCTCTTCGAGGGG
CTTTGGCGGCAGCAGGAGATTTTCTCCGGGGTTTCACGCTCCCCCCGATGCCAGT
GGTCACAGCCCAAGTCAGAGACTTGGAGTTGTGGCGGGACAGTGAGCTCTGTCA
GTGGTCAATAGCTCAATAAATATGGCAGCAGAGCTTGTCTCGGGGATTCACGCTC
CCCCCATTGTGAGTGTGTCGAACTGGTTTCGAAGGACGTCTAGAACGACGCTAAA
GTTCAAATCCGGCAACAGAGAGTTTATGTCTCGGGGCCTCACGCACCCCCCGTTG
TGAGTGAAGTCCTTTCTGGCCATTTAGTGGTCAGGAAGGGTACCGTTTTGGAACG
ACGGAAATAAGTTCCATGGAGCGACACTAGCCCCACTGAGGGGCGGTTGGAATG
ACACCCAACCCGCTATAGTGCGTCGACAGGTCAATTAGCTACCTGGAATAAGCTA
ATGTGCAGGGCAACAAAGTTCTAACGAACTAGGGTGAGTAGCGTCACCCCCCGG
TTGTGAAAACGATTGCGACTAGAACTAAAGTCGAGAGTCTCCCCACCGATAGGG
GAGCTCGTCAGTTTGTTTTAGTCCAATTACGCTGGGTCGGCATGGCATCTCCACCT
CCTCGCGGTCCGACCTGGGCATCCGAAGGAGGACGTCGTCCACTCGGATGGCTAA
GGGAGAGCCACTTTTCTCTCGATTCTCTATCGGAATCTAGGGAGCTCGGATCCAG
ACATGATAAGATACATTGATGAGTTTGGACAAACCACAACTAGAATGCAGTGAA
AAAAATGCTTTATTTGTGAAATTTGTGATGCTATTGCTTTATTTGTAACCATTATA
AGCTGCAATAAACAAGTTAACAACAACAATTGCTCGAGGGGGG
```

FIG. 94 cont.

>SEQ ID NO:399       PCV/KRBV-prME
GGGTCGGCATGGCATCTCCACCTCCTCGCGGTCCGACCTGGGCATCCGAAGGAGG
ACGTCGTCCACTCGGATGGCTAAGGGAGAGCCACTTTTCTCTCGATTCTCTATCGG
AATCTAGGGAGCTCGGATCCAGACATGATAAGATACATTGATGAGTTTGGACAA
ACCACAACTAGAATGCAGTGAAAAAAATGCTTTATTTGTGAAATTTGTGATGCTA
TTGCTTTATTTGTAACCATTATAAGCTGCAATAAACAAGTTAACAACAACAATTG
CTCGAGGGGGGGCCCGGTACCTTGAAGCTGTCCCTGATGGTCGTCATCTACCTGC
CTGGACAGCATGGCCTGCAACGCGGGCATCCCGATGCCGCCGGAAGCGAGAAGA
ATCATAATGGGGAAGGCCATCCAGCCTCGCGTCGGCGCTTAAGGATCATGATGAT
AAACAATGTATGGTGCTAATGTTGCTTCAACAACAATTCTGTTGAACTGTGTTTTC
ATGTTTGCCAACAAGCACCTTTATACTCGGTGGCCTCCCCACCACCAACTTTTTG
CACTGCAAAAAAACACGCTTTTGCACGCGGGCCCATACATAGTACAAACTCTACG
TTTCGTAGACTATTTTACATAAATAGTCTACACCGTTGTATACGCTCCAAATACAC
TACCACACATTGAACCTTTTTGCAGTGCAAAAAAGTACGTGTCGGCAGTCACGTA
GGCCGGCCTTATCGGGTCGCGTCCTGTCACGTACGAATCACATTATCGGACCGGA
CGAGTGTTGTCTTATCGTGACAGGACGCCAGCTTCCTGTGTTGCTAACCGCAGCC
GGACGCAACTCCTTATCGGAACAGGACGCGCCTCCATATCAGCCGCGCGTTATCT
CATGCGCGTGACCGGACACGAGGCGCCCGTCCCGCTTATCGCGCCTATAAATACA
GCCCGCAACGATCTGGTAAACAGTTTTAAAAAACTTTTGCGTTAGTAAAACCACG
GAGTTTTGGTTTGCTGAGAATAGTGCGAGGGTTGTTTTAATTATTTCGGAGATTTT
GGTTCGTGATGAATCAGGAGAGAGGAATACTCAGGGGTATGGGGAGGTTCCCCC
CCCCCCCTGTGAAGAAGGGGAACAAGAATTCTGTTGCCGTGGCCAGGGTGCCACC
GCAGCAAGGAGGAAAAGCGAGAGAGAAAAACCGTGAGAGGATTAAAGCGCCAG
GAGCGCGACATGGAGTTGCCGGAAAGATGAAAAGTCTAATGGGAGAATTGGGCT
TTGGATGGATTGATTTACTACGCGTTGATTTGGTGGAAGGAATTATGATGATGGT
TTTTGTTATACAGCGGGCTTTCGCCCAAGTGCACCGGAGAATTAGAGGATTATCA
AGACGCGTCAGGGCATTGGAGAAGAAGCGTGACGGTCGAGCGGCTATGTTCATT
TGGACTATATTGGCAATGTTATTCGGAGTTATGGGAAAGACCATGAATGGAATAA
TGGACAAGGGTGAGCACGTTTGGAAAGCTGACTGGAATGTTGACTTTACCAATGT
GAAGCTCCCCAAGGACTTCTGCGGATCTGGAATACACGTGGAGAAGATGTGTCCT
CAGGTTGATTCTTTGCAAGATGCAACAATCGACTGCGCAGGAAGACATGACCAAT
TTCTCCTGTCCTATACACGATGTGCGGCTAAGAATCGTGTCAAACGTGGTGAACC
CGGAGTAGTGGAACCGAAAGTCACGAACATATGGACCATAACGTTCAATGATGA
GTTGAACAGCATCATTGAACGTGTGAGCGGGATGCTGAAGAACAATCGATTGAT
GGCAACAGCAGTCATTTGCTTAGTTGGGGCTTTCAAGAAATGGCCTACATGGCTC
GTCGTGCTTTTGGTTTTACTGCCTTGGACTGTCGTGCAGGCATCACTGGCCGATCC
TTTCTTAATTCTGCCGAAGGGTGATGGTTTGGTAAAAACTAGATTATACCCAGGA
CAGATTTCATCAATTTCCACACACGTTGGGGTACTGGACATCTCTTATATGGCTGT
GGACATTGAGGAGGGGCGACTCGTTGAAAGGTTGATGTCACATTGCGAAGTAAA
TGGAACTTACTCACAGGATTGTTGCGCTTTGGGATGCAACTTGGACTTATCTAAGT
TAAATGAGCGGAACAGGGCCTGTCAAACGGCTACCTACAATCGCGGGTGGGCTA
CGGGATGTCCAGTTTTTGGACTGGGCAGTGTGGCCACATGCGTTGAGGTCGCGTG
CAGCGATAGTGTGGAGGTGTCCGAACTGACAAGCCAGAACATCCGGATTCCTCTA
TCTCTACGTTTGCAGCATGAAGAGCTGAATGTGACCATGACAACAGAGGCGCCAG
TTACTTCAAAGTTCTCACATCACGGGGTGGTATCCATCTCTTGTCAAATTGGCAAT
CCTGGGTTCTTGGCACAGCAGTACGTGCTGAGCAATGGGAAGCATAAAGCAATGT
TTCCCATCAGTGCGGTATCAGGTTGGCCTGGAATCCGTGAGATTGGTGGACAGTA
CAGGAACGTGGATGGCTCCGTCAAGTGGGGGCACGTTGAAGCGAATGAGATTAA
GGTGGCCGCTGTATATAGTGACAGCATCCAATGGAAGACTGGAATCCCGATAAA

FIG. 95

GACAGGTATTAGAGACCCACTGTATTTGTACTGTGAAGTGTCGCTAACTGACTTG
ACTTTCAAGAAAATAAGAGCATGTGAATCGCCTGTTGAAGTTTCGTTCATGGCAG
GACCTACGGGTTTGGATGGTCGRCTAGAAATTGGGTTGCTTGAGCAAGTCAACAA
AACATGCTCAATAACAGGGAGCTGTGAAGGTTGTACCTTACCGCACCCAACCAGT
GTCATTTCGACTTCTGACAAGAAAGGCCACATGCACGTAGAATGTCGCACGGGGA
CATTTACGGCAATATTCGGAAAGCAAAAATTTTCTTTCACCTGTCRRACWAGTTA
CCTCAGAACTATTTGGGCTACGACTGCCCAGGCGATTGGAAATTATAGGAAATTC
GGACTGGATGCCTCAGGAGGACCATTTTTGGACTTATGGAATAAGATAGGTCCAA
ATTTCTCCCGTTTGGAGGTTGTTGGAATCCTTGTTGTGGCAGCCTTGTTAATTGAC
AAAAGACTCTTACTTCTCCTGGCTATTTTTGGATACGTCACATACGTGCGAGCTGA
CTTCGGATGTGGATTTGACCCAGATAGGAAGGTAGCACAGTGTGGTTCTGGCTCA
TTCGTGTGGAAGTCACTGGCCCGTTGGCCAATGGCTGATCACGCTATTGAGTTTG
AAGATAGCAAAGTGATGGTGACTTACTTGACTGACCTATTGATGAGAAAGAACA
AAGTCTGCATAGTGTGTGAAGATGTATTGCAGTGTGCCGCAGCGCGTGGAGTTGT
CGAGCAGATAACGTCGATCAATGGAATCCCAATCCATCACAACATGTCGCTGTCG
CATGGCCGATATTTCCCACGTGTAGTGAAGAAAGTACACAATGTTAAGGTGGGAA
AAGCCATGTTGCGCCTTGCAATGGCCACATATGCGGGAGCGATGCCTGAGAGTGG
ATTGGGTGTTTTGAAGACGGGGTATTTTTCACGCGGAGAAGTGCAGGAAACGTGG
GATGATAAAGTTCTAAGAGTCCTAACCAGCGCCATAAATGCAGAGGAAGTGTGC
CAGACGGCTGTCACGTTCCAGTATGAGTTCGTTCGATATAACCGGAAAGTCTTTG
GATCTAACATCGTGTTGCGACCTTCAGCCTTTACGAGCAAAGCTTGCCCAACATA
TTTAGCTGGGGCTGTGGTCAAAAACGACATAGCAACGTTTACGGACGGAATGATG
TGGATGCGGAGCCGGAAAGTCAATGAAACGTGGGAACTGTTTGAGTTGGAAACA
ACCCAAAGCCACCAATGCATTTGGCCATACGCGTACACAATAGACCTAGCAACAC
CCACGGACAAGAGGCTTTTCATGCCGCCACAATACGGAGGACCAATTTCGTTTGC
GAACCACGTGCCTGGATTCCAGGTGCAAGAGGACTTTCCCTGGCAGAAGGCGAA
TATATTAATGCGCCAGGGACCGGTTCCGGGAACGACCGTAGTCCAGGATCCACAC
TGTGATGACCGGAGCGCGGCAGTGCCAGTTGAACCAACTATGCAAGCTTGGTGCT
GCAAGACCTGTTTTGATAGAGGAGTGAAGCCTTTCCATTTTGTGGTTGACGGGAA
ATTTTTCTATCCAATGGAAGTGCGGCCAATGAAACTGGAACAAGACGCTGTGGTG
ATTGAGACTGATGATGGAGAGTTCGAGAGGAGTGAGCATGAGAGCTTGTTTGAA
GGCAAAGCAAAGTGGACATCACCGTTACCAATGGGAGAAACAGCCAAGATTCAA
AATTTTTTCGTGACCAGCCCGCCAAAGCCGGAATCAAGCCTGCTTTTGGTGGGCG
TTCTGATTCATATGTTAACAACGCGAACCCGCCATCGGTGGGCAACTCGTTGTGC
TGGAACTTGGCTCATCTTTTTGGTCTTTGGACATCCGGTTGTGTCTTCGGTGCAGT
CTTGGGCGTGGCTCTTTATGTCAGCTGCCTTAGCAAGTGTCCCTGGTGGTTCTTCA
CTGGTGATCCACTTCTGGATTGGGTTGCAGATATCGTCAGCGCACCTCTTTTACCT
GGGTTGGTTAATGAGGAAACGCCTGTTGATTACAGAGATGTCGCGAGTGGCACAT
CTGATTGCCCAGTTGTGCAGCTTCGAGACATATGCGTGGGCACCGATCCTCAAAG
TACTGGATCACTTGCTGTTTCCACTCTACACTCTGTCAGTATTCGTCGTTCACCAG
CAGTTTCAGGTATTCCACGACTTGTGGCTACAGAGCGCCGTGGTGATGGCACACC
TGTTGCAACACCCTCTCAGTGGTTTAATAACCTTGAGTTTAAGCGTCGGCTTGATT
CAGCTAATAGCACCAATGAAAGATGGTTTTGCTCACCAGTTATATGGGGAGATG
GCTTACGCGCGCCGAGACCACACTGGACAGCCTTAACGTATTTCATCGTGCTGTA
TTTGGCAGCCGCTGGGATGGAGACAGTGGGTCTGCACACGTCCGGGATGACAGT
GATGCTGGGCGGGATGCTTCTGTGGGTTGTCCTACAGTTGATGCCCCCGACAGCC
TTGGAACTTGTGCGCCTACCGGGACAAAGTCTGCCAGACGGATGTGAAGAAGAA
GCGTC

FIG. 95 cont.

```
AACATCTCTACCAGAAGGAATGAGTGGGCATTACGCCCCCGATGGAGTTGAACTC
GTGAACTACACAGATGCAGGGACTGTCTCCGCAAACCTTGTGGTATTTGTTGGGT
GTGCTGGAATTATGACTATGAACATATACGTTGGGTTGGTTATCACGGCCTTGGC
CTGGGTAACGGACGCCCCGATGTGGATTCCAAGATTGATTGATGGTGCTATGTCC
CAGCGGGCAAATTCGGAGCTATTGCTGCCATCCCCACCTCTTGAGATACACAAGA
CGGAAGACTCGTTTGGTTACATCCCGGACGGAACATATCACGTGTTGGCTAGCAG
CTGGATGAGCAAGAAACCAGTTGGTGTTGGAGTGGTGAAGGAGGGCGTGTTTCA
CACGTTACACCACGTCACCAAAGGAGCTAATGTGACATGGGCAGGACGTGAGGT
TAGGATGCACTCTGGAGATGTTAGGCGGGATATTGCTGCCTATGGCGGGCCCTGG
AACATCAGCGGGAGTCTTGAAGATGTCGTAGTAGTGAAGGCCGTGAACAAGGAT
GGAACCGTGACATGCTGCCGGATTACAACAGCTAAGTTGGACATTGAAGGAACT
ACAGTGATGGCTGTTGAGCGAGATTTTGGTTTCGGCTCTTCGGGGTCCCCATATA
CGCTCCTGATGGACGGTTGATTGGCTTGTATGGATACGGGTTTTACTATGGAACG
TACTTCTCAATAGTTTCAACAGGAGAAGGAGTGGAGGCACCACCGGAAGAGGTT
GAAGTCTCAACACGTGAGTTTGTGGACTGGCACCCTGGAAGAGGAAAAACGCGC
ACGATACTCGTTGAGCAGGCCCTGAAGCATATAGCTGATGGAAAGAGGTTGCTA
ATTTTGACACCAACGCGGGTCGTAAAGGATGAAGTGCAGCGAGCGATAAAGGAA
GCCGCCCCGCAGGCGGTTATCGGATCGAACTTAAGCATTTTTCGGAAGAACGCCG
TTACCTTGGCATGCCACGCGACCTTCACGCAGTATGTGATGGAGAAGGGGATAGA
AAGTGTGAAGTTTTCGACCATCATTATGGACGAGTGCCACTTTCTGGACCCGATG
TCCATCGCGTGCCGCGGGATAATGGATTTCCACAACAGCCGTGGAACGAAGGTCA
TCTTCATGAGTGCGACGCCCCAGGACGAGCAGGAAACGCTGGGTCCAACTTTAC
AATAGAAGACAGAGCCATCAAGTTCCCCAAGGAGTTGACCGCATCGTGGATCAA
AGACAAGTCAATAGGCAAGACCATCGTTTTTGTGCCAACAATTACGCAAGCTGTG
AGGCTGGCTAAAGAGTTGGGAGGGGTGGCCTTGACCCGAGATACGTTCAATGAT
GCCATGGGGAAGGCCCGGAGTCCGGAAACAATGTTTATAATCTCAACAGACATC
AGCGAGATGGGAGCCAATCTCGGAGTGACTACTGTTATCGACACAAGAACTGTTA
TAAAACCATTAGTGTCTGACAAAGGAGTTTCACTTGAAAGGGTTGGTGTGACCCC
AGCTTCAATCATCCAGCGCAGGGGCCGAGTAGGTCGGCGGGAGCCCGGAGTATA
CATTTATCCCCTTGACGTCGAACCAGAGGAGCAGCCGGAAAATTGGGTGTGTTGG
GTGGAGGCGCAAATGATCTTAGATCAATTGGGCTGCCATCCGATGAGAGAGGAG
AGCGAATTTTTCCGCCCACAAGGCACGTACCGGATTGACGACGTAGAGCAGCGG
AGGTTTCTGGGGTTGATCAAGGAAAAACTGCCAATTTGGCTTGCTTGGACTTGGG
CCAGCTCACATGCGAACAAACATCAGATGCTATTTCAGGGAAACGCCCCAACAC
TGGACGAACATTAAAAATAAAGACGCCATCCGGATCTCACATTTACGCCCCAAAG
GTGACAGATGATAGGTTTGAAAAGGAGCCAGAAATTGTGAAAGTGGCGGCCATC
GGATTCTTCCTAAAGCAGAGATCACTATACTTCGACTTACCTGGATTATTGACCG
GATTGTACACGGTGTTGACAACGGCTGGGCTCGATGCCCTTGGAAATTCGTTCAA
ACGCTCTGTGGACACCCTTCACGACATCGGAAATGCGGTGGAAGGAGAGTTTTCT
GCTATACAAATGGGACGGATTTTACAGATGTGGTCTGCGTTGTTTATCGGGGTGA
CTTTGGGAGTTGTGCTGATGGGAGCCGGATTTGTTGTGGTGAAGGCTTTTAGAGG
ATTGTTTGGAACCCGCCAACAACACACAACTGTGTGCGTGTCGGAGGGCGGAAGT
TTCCAAAAAGTTGCCACGGTTCTAATGAGCGTTGGACCATTGTGCGCCGTTTTGG
TGGCATTCCCTCTATATTCGTCTTCATTGTGACCGTTGCCCTGTTGATTGTGCTGTG
TGTGGGCGGAGGTGGCTCTCAACGTGGTGTGCTTGATTCGGATCTAATACGCTGG
GTCATGGTGTTGGCCATGATGACAATCGGAGTGACTGCGTGGGAGTTGGAGCTAT
TACCAAACGTGAGAAGAGATGTTATACAGTTGACTCGATACCTGTTTGCTAGCAA
TCCTGCCGTTGTTGGAGCTGTGTTTAACGCCGGGAATATCGGATTGGGAGTCTCTC
TGCCAGGGACCCTCATGATGAGCTACGCCGCGAGCGGAACGCTGGCCCCCCTTAT
TGGAGCGTGGGCCGAAGGAAATTTCTTAGGAAAGCTCTTTGGTAGCGAAGTGCTT
```

FIG. 95 cont.

```
CCAGCTCAGGCTATAGGCGGATTTCAAGTGACAGCTATCCCGTGGGGATCTATGG
TGCCGGTTATCGCTGGTTGCTTTCTAGCGACAAACACTCTTTCGAAAGTGTTTGGT
GCTGGAATTACAACTGTGTTTCTCATACTACTCTACTTCGACAAGAAACATGCATT
CACGAACAAGGCTGTTAAGGTTTTGTTGGCGCGGACAAACAGAAGGGACATGGA
GGAAGAAATCACAACAAGGGACGCGGAGTCGCGGGCTCGCCAACTGTTTTATGG
CCTACAACTGGCCGTATCGTTGCTGTGGGTTCTCTCACATCCTGTGTTGGAAAACT
TCGTTCCATTCTTTGCTGTGTGCGGGTACACATTCCTGTCGCTCTTGAGGCCAAAT
CATCAACTACATGCTGCGTTGGATTATACATTGGTAGTCCTGCTCTTGCAGGTAGT
TGAACCTGGGAACATCATGTACGTCGGCGGATGCGTTTTGTTATGGTATGTTTTAA
ACCCTACCAGATTGGGCGTGCGCTCGCTGGTGAAGAGTGACACCGGAGGTTTAGG
CTTCCGTTGGAAGAAAGCGTTGAATTCACTTAGTGAGAGGCAGTTTGCCATCTAC
AAAGTCAGAGGCGTGAATGAAACTGATAAAGGAGCCTACGTGTCGCGAGGTGGT
TTAAAAATGAACGAGATTATCAACAAGCATGCGTGGGAACCTCGAGGAGTTGTC
GTTGACCTGGGATGTGGACGAGGAGGTTGGTCCCAGCGCTTGGTGATGGATTACC
GCGTCGCTGAAGTAAGAGGATACACACTTGGAGGCAAAGAACGTGAGAATCCCC
AACCGTTCCAAACGAAAGGATATAACTTGGCGAATTTGAAGGCTGGAGTTGACGT
CTATAAAATGGAGCCAGTGAATTGTAACACCATAATTTGCGACATAGGTGAGAGT
GACCCGCGTCCTGAAGTTGAAAAAACTCGAACGCTGAAGGTTTTGGGAATGCTGG
AGAAATGGCTGGAAGTCAATCCAAACGCCTCTTTTTGCTGCAAAGTGCTATCACC
TTATCACTTGGACGTGCTTCGAAAGTTAGAGTCGCTGCAACACAAGTATAACGGG
CGGCTGGTTCGACTGTCTTACAGTCGGAACTCAACAGCAGAAATGTATTATGTGT
CAGGAAAGAGGGCAAACGTGGTGGCAAGCGTGTACTTCATGCTTGGGTCGCTGG
TAGGTAGGCTGCGGAGACATGAGCCATCAATCATCGACCCCCACCGGTTCTAGA
GATGGGAACCAGAAGCGATCCGCGAGCAAAGGCCAAAGCGCAAGACTTCGAGAT
GATCCGAAGAAGAGTGGAACGACTACGAGGAGAAAATCGGAAAACATGGTTTGT
GGACAACGAACATCCATATGTGTCATTTAACTACCATGGATCCTTCGTGACTGAT
GAGGTGACAGCGGGCGGACAAACAACAAATCCCTTGATTAGACGCGTTATGTGG
CCATGGGACTTTCTGTCTCGGGTGACAACCTTTATGATGACCGATGTTTCAACGTA
TGCCCAACAAAAGGTGCTGCGTGAAAAAGTGGACACTGTCTCTGAGGAGCCCGA
CGAGCGAATGAAAGCAATTAACAGACTCATCATGACACACTTCGTGAAAATGTTC
AAGCGGCGCGGGCTGAAACCGAGGGTGTTGACACCACAAGACTACATGAATAAT
GTCCAAGCCAACGCAGCCATAGGAGGATGGAGCGAAGTAATGGATTGGCAAAAC
GTGCGCGATGCTTTGGCAGATCAACGATTCTGGGACATGGTAGATAACGAGAGG
GCCTTACACTTGCGTGGTGACTGTGAGCTTTGCATCTATAACACGATGGGAAAGA
AAGAAAAGAAGCCATCTGCCTTTGGCACTGCGAAAGGTTCACGCACCATCTGGTA
TATGTGGCTGGGTAGCCGTTATTTAGAGTACGAGGCTTTAGGATTCTTGAACGAA
GATCATTGGGTTGCACGAGAAAACTTTCCATGTGGAGTCGGTGGCGTCGGCGTTA
ACTATTTTGGATATTACCTGAAGGAAATAGCCGGGGGAGGCCGGTGGCTTATCGC
AGACGATGTCGCGGGATGGGACACGAGAATAACCCAAGGAGATCTAGATGATGA
GCTGTTCATGTTAACCGAGCTTGCCCCAACCACATACCACAAGAAATTGATAACT
GCGACAATGACGTTGGCTTATAAAACATAGTGGCCTTATTCCCTAGAAATCATC
CGATGTACCGAAGTGGAACTGTTCTTGATGTGTTGTCTCGAACGGATCAGCGTGG
GTCGGGCCAGGTGACAACATACGCTTTGAACACTGTGACTAATGGAAAGTGCCA
GGTCGGGAGAACATTAGAAGCGTGTGGCTTGCTGGACGCCCCGCTCACCACAATC
GACTCCTGGCTCACTGCCAACTTGGAACGAGTTCTTGGAGCAATGGTCGTTGCCG
GAGATGATGTGGTAGTGGCGACAGACAATGAAGAATTCCACACGAGTTTGAGAT
ACATAACAGCGACGTCAAAGATCCGAAAGAACTTAGGGGTGAGTGAGCCATCGC
CGAGATTCACGAGCTGGGAAGATGTTGAGTTTTGCTCACACCACTTCCATCCACT
GACGTTACGTGATGGCCGTGTGCTGATCGCCCCGTGTCGTGACCAAAACGAAATT
ATCGGAAGATCAAGAA
```

FIG. 95 cont.

```
TCCAGAAAGGCGGAATAGTTGACATGGCCTCGGCTGGGTGCTTAGCGAAGGCTC
ACGCGCAGATGTGGGCCCTTTACTTCTTCCATCGGCGAGACTTACGGATTGGATT
CGCGGCCATCACATCAATTGTGCCTATCAACTGGGTGCCGACGGGCAGGATATCA
TGGTCTATCCACCAGAACGCAGAGTGGATGACGACTGAGGATATGCTAACGGTTT
GGAACAACGTGTGGATTAGGGACAATCCGTGGATGAGAGGAAAAGAACGAGTGA
CTTCATGGACAGACATACCGTATTTACCCAAAGGAGTGGACATAAAGTGCGGAA
GCCTAATAGGCGATTCCGACCGCGCTTCCTGGTCAAAGACGATTCCCCTAGTTGT
GGAGAAGACCCGAAAAATCCTTGAGCAGGAGAGGGGAACATTGAAGTTCTACAA
TGGGTTATCCATTCTAGGACGGTATGTTCACCACGTCGATCCTGTGTTCAACTGAA
GTGTGACGATGTAGGCCCGCGGGAGCCTTAGAATTCAAGAGCTTGGGAATTCTAG
AATCCCGTTTACCGCAGGAGGGGGTCATATGGAGCAGGTGGCTATGTATAGCCTG
GCTAAATGTATGGCTCCTGGGGGAGTGACGCCCCTCCGGTTCCAGTTCCTGGGTG
AACAGGTAAAAACCACCACGAAGCGCCGCTTCAACATCGCAAGGGGGAGAAATC
CCGGGTGCTGACGCCACCCCGACCCCAGTCCCACATAAGGCTGTGACGAAAGAG
CCTTACCGGCACGAGGAGTGCCCACCGCAAGGAGGAGAAATCCTGGGCGTTGAC
GACGCCCCGGCCCCAGTCTCTGATAGGTGACCAGAACCATGTCACCCCAAAGTGT
TGAAAGGACACTGATCACCAGAAATGGTGAGGGCACACAGGGCTTAGCCCAAGG
TGAGTGACGACACCTCCCGAAATGTGTAAATAGCAGGGTCAGCTCTAAGCAGCA
GGCTTCCACCGTTAGGAAGCGTTGCTGTGAGCTTACTTGGCTACGTCT
```

FIG. 95 cont.

>SEQ ID NO:400          PCV/ZIKV-prME P1

```
   1 agtttaaaa aacttttgcg ttagtaaaac cacggagttt tggtttgctg agaatagtgc
  61 gagggttgtt ttaattattt cggagatttt ggttcgtgat gaatcaggag agaggaatac
 121 ycaggggtat ggggaggttc cccccccccc ntgtgaagaa ggggaacaag aattctgttg
 181 ccgtggccag ggtgccaccg cagcaaggag gaaaagcgag agagaaaaac cgtgagagga
 241 ttaaagcgcc aggagcgcga catggagttg ccggraagat gaaaagycta atgggagaat
 301 tgggctttgg atggattgat ttactacgcg ttgatttggt ggaaggaatt atgatgatgg
 361 kttttgttat acagcgggct ttcgcccaag tgcaccggag aattagagga ttatcaagac
 421 gcgtcagggc attggagaag aagcgtgacg gtcgagcggc tatgttcatt tggactatat
 481 tggcaatgtt attcggagtt atgggagcgg aggtcactag acgtgggagt gcatactata
 541 tgtacttgga cagaaacgat gctggggagg ccatatcttt tccaaccaca ttggggatga
 601 ataagtgtta tacagcagatc atggatcttg acacatgtg tgatgccacc atgagctatg
 661 aatgccctat gctggatgag ggggtggaac cagatgacgt cgattgttgg tgcaacacga
 721 cgtcaacttg ggttgtgtac ggaacctgcc atcacaaaaa aggtgaagca cggagatcta
 781 gaagagctgt gacgctcccc tcccattcca ctaggaagct gcaaacgcgg tcgcaaacct
 841 ggttggaatc aagagaatac acaaagcact tgattagagt cgaaaattgg atattcagga
 901 accctggctt cgcgttagca gcagctgcca tcgcttggct tttgggaagc tcaacgagcc
 961 aaaaagtcat atacttggtc atgatactgc tgattgcccc ggcatacagc atcaggtgca
1021 taggagtcag caatagggac tttgtggaag gtatgtcagg tgggacttgg gttgatgttg
1081 tcttggaaca tggaggttgt gtcaccgtaa tggcacagga caaaccgact gtcgacatag
1141 agctggttac aacaacagtc agcaacatgg cggaggtaag atcctactgc tatgaggcat
1201 caatatcaga catggcttcg gacagccgct gcccaacaca aggtgaagcc taccttgaca
1261 agcaatcaga cactcaatat gtctgcaaaa gaacgttagt ggacagaggc tggggaaatg
1321 gatgtggact tttttggcaaa gggagcctgg tgacatgcgc taagtttgca tgctccaaga
1381 aaatgaccgg gaagagcatc cagccagaga atctggagta ccggataatg ctgtcagttc
1441 atggctccca gcacagtggg atgatcgtta atgacacagg acatgaaact gatgagaata
1501 gagcgaaggt tgagataacg cccaattcac caagagccga agccaccctg ggggtttg
1561 gaagcctagg acttgattgt gaaccgagga caggccttga cttttcagat ttgtattact
1621 tgactatgaa taacaagcac tggttggtcc acaaggagtg gttccacgac attccattac
1681 cttggcacgc tgggcagac accggaactc cacactgaa caacaaagaa gcactggtag
1741 agttcaagga cgcacatgcc aaaaggcaaa ctgtcgtggt tctagggagt caagaaggag
1801 cagttcacac ggcccttgct ggagctctgg aggctgagat ggatggtgca aagggaaggc
1861 tgtcctctgg ccacttgaaa tgtcgcctga aatggataa acttagattg aagggcgtgt
1921 catactcctt gtgtaccgca gcgttcacat tcaccaagat cccggctgaa acactgcacg
1981 ggacagtcac agtggaggta cagtacgcag ggacagatgg accttgcaag gttccagctc
2041 agatgcggt ggacatgcaa actctgaccc cagttgggag gttgataacc gctaaccccg
2101 taatcactga aagcactgag aactctaaga tgatgctgga acttgatcca ccatttgggg
2161 actcttacat tgtcatagga gtcggggaga agaagatcac ccaccactgg cacaggagtg
2221 gcagcaccat tggaaaagca tttgaagcca ctgtgagagg tgccaagaga atggcagtct
2281 tgggagacac agcctgggac tttggatcag ttggaggcgc tctcaactca ttgggcaagg
2341 gcatccatca aattttttgga gcagctttca atcattgtt tggaggaatg tcctggttct
2401 cacaaatcct cattggaacg ttgctgatgt ggttgggtct gaacacaaag aatggatcta
2461 ttccccttat gtgcttggcc ttaggggggag tgttgatctt cttatccaca gccgtctctg
2521 ctgacttcgg atgtggattt gacccagata ggaaggtagc acagtgtggt tctggctcat
2581 tcgtgtggaa gtcactggcc cgctggccaa tggctgatca cgcyattgag tttgaagata
2641 gcaaagtgat ggtgacttac ttgactgacc tattgatgag aaagaacaaa gtctgcatag
2701 tgtgtgaaga tgtrttgcar tgtgcygcag cgcgtggagt tgtcgagcar ataacgtcga
2761 tcaatggaat cccaatccat cacaacatgt cgctgtcgca tggccgatat ttccacgtg
2821 tagtgaagaa agtacacaat gttaaggtgg gaaaagccat gttgcgycctt gcaatggcca
```

FIG. 96

```
2881 catatgcggg agcgatgcct garagtggat tgggtgtttt gaagacgggg tatttttcac
2941 gcggagaagt gcaggaaacg tgggatgata aagttctaag agtcctaacc agcgccataa
3001 atgcrgagga agtgtgccag acggctgtca ckttccagta tgagttcgtt cgatataacc
3061 ggaaagtctt tggatctaac atcgtgttgc gaccttcagc ctttacgagc aaagcttgcc
3121 caacatattt agctggggct gtggtcaaaa acgacatagc aacgtttacg gacggaatga
3181 tgtggatgcg gagccggaaa gtcaatgaaa cgtgggaact gtttgagttg gaaacaaccc
3241 aaagccacca atgcatttgg ccatacgcgt ayacaataga cctagcaaca cccacggaca
3301 agaggctytt catgccgcca caatacggag gaccaatttc gtttgcgaac catgtgcctg
3361 gattccaggt gcaagaggac tttccctggc agaaggcgaa tatattaatg cgccagggac
3421 cggttccggg aacgaccgta gtccaggatc cacactgtga tgaccgaagt gcggcagtgc
3481 cagtcgaacc aactatgcaa gcttggtgct gcaagacctg ttttgataga ggagtgaagc
3541 ctttccattt tgtggttgac gggaaatttt tctatccaat ggaagtgcgg ccaatgaaac
3601 tggaacaaga cgctgtggtg attgagactg atgatggaga gttcgagagg agtgagcatg
3661 agagcttgtt tgaaggcaaa gcaaagtgga catcaccgtt accaatggga gaaacagcca
3721 agatccaaaa ttttttcgtg accagcccgc caaagccgga atcaagcctg cttttggtgg
3781 gcgttctgat tcatatgtta acaacgcgaa cccgccatcg gtgggcaact cgttgtgctg
3841 gaacttggct catcttttg gtctttggac atccggttgt gtcttcggtg cagtcttggg
3901 cgtggctctt tatgtcagct gccttagcaa gtgtccctgg tggttcttca ctggtgatcc
3961 acttctggat tgggttgcag atatcgtcag cgcacctctt ttacctgggt tggttaatga
4021 ggaaacgcct gttgatcaca gagatgtcgc gagtggcaca tctgattgcc cagttgtgca
4081 gcttcgagac atatgcgtgg gcaccgatcc tcaaagtact ggatcacttg ctgtttccac
4141 tctacactct gtcagtattc gtcgttcacc agcagtttca ggtattccac gacttgtggc
4201 tacagagcgc cgtggtgatg gcacacytgy tkcaacaccc tctcagtggt ttaataacct
4261 tgagtttaag cgtcggcttg attcagctaa tagcaccaat gaaaagatgg ttttgctcac
4321 cagttatatg gggagatggc ttacgcgcgc cgagaccaca ctggacagcc ttaacgtatt
4381 tcatcgtgct gtatttggca gccgctggga tggagacagt gggtctgcac acgtccggga
4441 tgacagtgat gctgggcggg atgcttctgt gggttgtcct acagttgatg cccccgacag
4501 cyttggaact tgtgcgccta ccgggacaaa gyctgccaga cggatgtgaa gaagaagcrt
4561 caacatcyct accagamgga atgagtgggc attacgcccc ygatggagtt gaactcgtga
4621 actacacaga tgcaggract gtctccgcaa accttgtggt rtttgttggg tgtgctggaa
4681 ttatgacyat gaacatatac gttgggttgg ttatcacggc cttggcctgg gtaacggacg
4741 ccccgatgtg gattccraga ttgattgatg gygctatgtc ccagcgggca aattcggagc
4801 tattgctgcc atcccccacct cttgagatac acaagacgga agactcgttt ggttacatcc
4861 cggacggaac atatcacgtg ttggctagca gctggatgag caagaaacca gttggtgttg
4921 gagtggtgaa ggagggcgtg tttcacacgt tacaccacgt caccaaagga gctaatgtga
4981 catgggcagg acgtgaggtt aggatgcact ctggagatgt taggcgggat attgctgcct
5041 atggcgggcc ctggaacatc agcgggagtc ttgaagatgt cgtagtagtg aaggccgtga
5101 acaaggatgg aaccgtgaca tgctgccgga ttcaacagc taagttggac attgaaggaa
5161 ctacagtgat ggctgttgag cgagattttg gtttcggctc ttcggggtcc cccatatacg
5221 ctcctgatgg acggttgatt ggcttgtatg gatacgggtt ttactatgga acgtacttct
5281 caatagtttc aacaggagaa ggagtggagg caccaccgga agaggttgaa gtctcaacac
5341 gtgagtttgt ggactggcac cctggaagag gaaaaacgcg cacgatactc gttgagcagg
5401 ccctgaagca tatagctgat ggaaagaggt tgctaatttt gacaccaacg cgggtcgtaa
5461 aggatgaagt gcagcgagcg ataaaggaag ccgccccgca ggcggttatc ggatcgaact
5521 taagcatttt tcggaagaac gccgttacct tggcatgcca cgcgaccttc acgcagtatg
5581 tgatggagaa ggggatagaa agtgtgaagt tttcgactat cattatggac gagtgccact
5641 ttctggaccc gatgtccatc gcgtgccgcg ggataatgga tttccacaat agccgtggaa
5701 cgaaggtcat cttcatgagt gcgacgcccc caggacgagc aggaaacgct gggtccaact
5761 ttacgataga agacagagcc attaagttcc ccaaggagtt gaccgcatcg tggatcaaag
5821 agaagtcaat aggcaagacc atcgtttttg tgccaacaat tacgcaagct gtgaggctgg
```

FIG. 96 cont.

5881 ctaaagagct gggaggggtg gccttgaccc gagatacgtt caatgatgcc atggggaagg
5941 cccggagtcc ggaaacaatg tttataatct caacagacat tagcgagatg ggagccaacc
6001 tcggagtgac tactgttatc gacacaagaa ctgttataaa accattagta tctgacaaag
6061 gagtttcact tgaaagggtt ggtgtgaccc cagcttcaat catccagcgc aggggtcgag
6121 ttggtcgacg agagcccgga gtatacattt atccccttga cgtcgaacca gaggagcagc
6181 cagaaaattg ggtgtgttgg gtggaggcgc aaatgatcct agatcaattg ggctgccatc
6241 cgatgagaga ggagagcgaa tttttccgcc cgcaaggcac gtaccggatt gacgacgttg
6301 agcagcggag gtttctcggg ttgatcaagg aaaaactgcc aatttggctt gcttggactt
6361 gggctagctc acatgcgaac aaacatcaga tgctatttca gggaaacgcc cccaacactg
6421 gacgaacatt aaaaataaag acgccatccg gatctcacat ttacgcccca aaggtgacag
6481 atgataggtt tgaaaaggag ccagaaattg tgaaagtggc ggccatcgga ttcttcctaa
6541 agcagagatc actayacttc gacttacctg gattattgac cggattgtac acggtgttga
6601 caacggctgg gctcgatgcc cttggaaatt cgttcaaacg ctctgtggac acccttcacg
6661 acatcggaaa tgcggtggaa ggagagttt ctgctataca aatgggacgg attttacaga
6721 tgtggtctgc gttgtttatc ggggtgactt tgggagttgt gctgatggga gccggatttg
6781 ttgtggtgaa ggcttttaga ggattgtttg gaacccgcca acaacacaca actgtgtgcg
6841 tgtcggaggg cggaagtttc caaaaagttg ccacggttct aatgagcgtt ggaccattgt
6901 gcgccgtttt tggtggcatt ccctctatat tcgtcttcat tgtgaccgtt gccctgttga
6961 ttgtgctgtg tgtgggcgga ggtggctctc aacgtggtgt gcttgattcg gatctaatac
7021 gctgggtcat ggtgttggcc atgatgacaa tcggagtgac tgcgtgggag ttggagctat
7081 taccaaacgt gagaagagat gttatacagt tgactcgata cctgtttgct agcaatcctg
7141 ccgttgttgg agctgtgttt aacgccggga atatcggatt gggagtctct ctgccaggga
7201 ccctcatgat gagctacgcc gcgagcggaa cgctggcccc ccttattgga gcgtgggccg
7261 aaggaaattt cttaggaaag ctctttggta gcgaagtgct tccagctcag gctataggcg
7321 gatttcaagt gacagctatc ccgtggggat ctatggtgcc ggttatcgct ggttgctttc
7381 tagcgacaaa cactctttcg aaagtgtttg gtgctggaat tacaactgtg tttctcatac
7441 tactctactt cgacaagaaa catgcattca cgaacaaggc tgttaaggtt ttgttggcgc
7501 ggacaaacag aagggacatg gaggaagaaa tcacaacaag ggacgcggag tcgcgggctc
7561 gccaactgtt ttatggccta caactggccg tatcgttgct gtgggttctc tcacatcctg
7621 tgttggaaaa cttcgttcca ttctttgctg tgtgcgggta cacattcctg tcgctcttga
7681 ggccaaatca tcaactacat gctgcgttgg attatacatt ggtagtcctg ctcttgcagg
7741 tagttgaacc tgggaacatc atgtacgtcg gcggatgcgt tttgttatgg tatgttttaa
7801 accctaccag attgggcgtg cgctcgctgg tgaagagtga caccggaggt ttaggcttcc
7861 gttggaagaa agcgttgaat tcacttagtg agaggcagtt tgccatctac aaagtcagag
7921 gcgtgaatga aactgataaa ggagcctacg tgtcgcgagg tggtttaaaa atgaacgaga
7981 ttatcaacaa gcatgcatgg gaaccccgag gagttgtcgt tgacctagga tgtgggcgag
8041 gaggctggtc ccagcgcttg gtgatggatt accgcgtcgc tgaagtaaga ggatacactc
8101 ttggaggcaa agaacgtgag aatccccaac cgttccaaac gaaaggatac aacttggcga
8161 atttgaaggc tggagttgac gtctacaaaa tggagccagt gaattgcaac accattattt
8221 gcgacatagg tgagagtgac ccacgccctg aagttgaaaa gacacgaacg ctgaaggttt
8281 tgggaatgct rgagaaatgg ytggaagtca atccaaacgc ctcttttgc tgcaaagtgc
8341 trtcrcctta tcacttggac gtgcttcgaa agttagagtc gctgcaacac aagtataayg
8401 grcggctggt tcgaytgtct tacagtcgga actcaacagc agaaatgtat taygtgtcag
8461 gaaagagrgc aaacgtggtg gcaagcgtgt acttcatgct ygggtcgctg gtaggtaggc
8521 tgcggagaca tgagccatca atcatcgacc ccccrccrgt tctagagatg ggaaccagaa
8581 gcgatccgcg rgcaaaggcs aaagcgcaag acttcgagat gatccgaagr agagtrgaac
8641 gaytacgagg agaaaaycgg aaaacatggt ttgtrgacaa cgaacatcca tatgtgtcat
8701 tyaactacca tggatccttc gtgactgatg aggtgacagc gggcggacaa acracaaatc
8761 ccttgattag acgcgtyatg tggccatggg actttctgtc tcgggtgaca accttatga
8821 tgaccgatgt ttcaacgtay gcccaacaaa aggtgctgcg ygaaaargtg gacactgtct

FIG. 96 cont.

```
8881 ctgaggagcc cgacgagcga atgaaagcaa ttaacagrct yatcatgaca cacttcgtra
8941 aaatgttcaa gcggcgcggg ytgaaaccga gggtgttgac accacaagac tacatgaata
9001 atgtccaagc caacgcagcc ataggaggat ggagcgaagt gatggattgg caaaacgtgc
9061 gcgatgcttt ggcagatcaa cgattttggg acatggtaga taacgagaga gccttacact
9121 tgcgtggtga ctgtgagctt tgcatttata acacgatggg aaagaaggaa aagaagccat
9181 ctgcctttgg cactgcgaaa ggttcacgca ccatctggta tatgtggctt ggaagccgtt
9241 atttagagta cgaggcttta ggattcttga acgaagatca ttggggttgca cgagaaaact
9301 ttccatgtgg agtcggtggc gtcggtgtta attattttgg atattatctg aaggaaatag
9361 ccgagggagg ccgatggtta atcgcagacg acgtcgcggg atgggacacg agaataaccc
9421 aaggagatct agatgacgag ctgttcatgt taactgagct tgccccaacc acataccaca
9481 agaaattgat aactgcgaca atgacgttgg cttataaaaa catagtggcc ttattccta
9541 gaaatcatcc gatgtaccga agtggaaccg ttcttgatgt gttgtctcga acggatcagc
9601 gtgggtcggg ccaggtgaca acatacgctt tgaacactgt gactaatgga aagtgccagg
9661 tcgggagaac attagaagcg tgtggcttgc tggacgcccc gctcaccaca atcgactcct
9721 ggctcactgc caacttggaa cgagttcttg gakcaatggt cgttgccgga gatgatgtgg
9781 tagtggcgac agacaatgaa gaattccaca cgagtttgag atacataaca gcgacgtcaa
9841 agatccgaaa gaacttaggg gtgagtgagc catcgccgag attcacgagc tgggaagatg
9901 ttgagttttg ctcacaccac ttccatccac tgacgttacg tgatggccgt gtgctgatcg
9961 ccccgtgtcg tgaccaaaac gaaattatcg gaagatcaag aatccagaaa ggcggaatag
10021 ttgacatggc ctcggctggg tgcttagcga aggctcacgc gcagatgtgg gccctttact
10081 tcttccatcg gcgagactta cggattggat tcgcggccat cacatcaatt gtgcctatca
10141 actgggtgcc gacgggtagg atatcatggt ctattcacca gaacgcagag tggatgacga
10201 ctgaggatat gctaacggtt tggaacaacg tgtggattag ggacaatccg tggatgagag
10261 gaaaagaacg agtgacttca tggacagaca taccgtattt acccaaagga gtggacataa
10321 agtgcggaag cctaataggc gattccgacc gcgcttcctg gtcaaagacg attcccctag
10381 ttgtggagaa gacccgaaaa atccttgagc aggagagggg aacattgaag ttctacaatg
10441 ggttatccat tctaggacgg tatgttcacc aygtcgatcc tgtgttcaac tgaagtgtga
10501 cgatgtaggc ccgcgggagc cttagaattc aagagcttgg gaattctaga atcccgttta
10561 ccgcaggagg gggtcatatg gagcaggtgg ctatgtatag cctggctaaa tgtatggctc
10621 ctgggggagt gacgcccctc cggttccagt tcctgggtga acaggtaaaa accaccacga
10681 agcgccgctt caacatcgca aggggggagaa atcccgggtg ctgacgccac cccgaccccca
10741 gtcccacata aggctgtgac gaaaragcct taccggcacg aggagtgccc accgcaagga
10801 ggagaaatcc tgggcgttga cgacgccccg gccccagtct ctgataggtg accagaacca
10861 tgtcacccca aagtgttgaa aggacactga tcaccagaaa tggtgagggc acacagggct
10921 tagcccaagg tgagtgacga cacctcccga aatgtgtaaa tagcagggtc agctctaagc
10981 agcaggcttc caccgttagg aagcgttgct gtgagcttac ttggctacgt ct
```

FIG. 96 cont.

>SEQ ID NO:401     PCV/ZIKV-prME P10

```
   1 agttttaaaa aacttttgcg ttagtaaaac cacggagttt tggtttgctg agaatagtgc
  61 gagggttgtt ttaattattt cggagatttt ggttcgtgat gaatcaggag agaggaatac
 121 tcaggggtat ggggaggttc ccccccccc ctgtgaagaa ggggaacaag aattctgttg
 181 ccgtggccag ggtgccaccg cagcaaggag gaaaagcgag agagaaaaac cgtgagagga
 241 ttaaagcgcc aggagcgcga catggagttg ccgggaagat gaaaagccta atgggagaat
 301 tgggctttgg ctggattgat ttactacgcg ttgatttggt ggaaggaatt atgatgatgg
 361 ttttgttat acagcgggct ttcgcccaag tgcaccggag aattagagga ttatcaagac
 421 gcgtcagggc atggagaag aagcgtgacg gtcgagcggc tatgttcatt tggactatat
 481 tggcaatgtt attcggagtt atggagcgg aggtcactag acgtgggagt gcatactata
 541 tgtacttgga cagaaacgat gctggggagg ccatatcttt tccaaccaca ttggggatga
 601 ataagtgtta tacagatc atggatcttg gacacatgtg tgatgccacc atgagctatg
 661 aatgccctat gctggatgag ggggtggaac cagatgacgt cgattgttgg tgcaacacga
 721 cgtcaacttg ggttgtgtac ggaacctgcc atcacaaaaa aggtgaagca cggagatcta
 781 gaagagctgt gacgctcccc tcccattcca ctaggaagct gcaaacgcgg tcgcaaacct
 841 ggttggaatc aagagaatac acaaagcact tgattagagt cgaaaattgg atattcagga
 901 accctggctt cgcgttagca gcagctgcca tcgcttggct tttgggaagc tcaacgagcc
 961 aaaaagtcat atacttggtc atgatactgc tgattgcccc ggcatacagc atcaggtgca
1021 taggagtcag caatagggac tttgtggaag gtatgtcagg tgggacttgg gttgatgttg
1081 tcttggaaca tggaggttgt gtcaccgtaa tggcacagga caaaccgact gtcgacatag
1141 agctggttac aacaacagtc agcaacatgg cggaggtaag atcctactgc tatgaggcat
1201 caatatcaga catggcttcg gacagccgct gcccaacaca aggtgaagcc taccttgaca
1261 agcaatcaga cactcaatat gtctgcaaaa gaacgttagt ggacagaggc tggggaaatg
1321 gatgtggact ttttggcaaa gggagcctgg tgacatgcgc taagtttgca tgctccaaga
1381 aaatgaccgg gaagagcatc cagccagaga atctggagta ccggataatg ctgtcagttc
1441 atggctccca gcacagtggg atgatcgtta atgacacagg acatgaaact gatgagaata
1501 gagcgaaggt tgagataacg cccaattcac caagagccga agccaccctg ggggttttg
1561 gaagcctagg acttgattgt gaaccgagga caggccttga cttttcagat ttgtattact
1621 tgactatgaa taacaagcac tggttggtcc acaaggagtg gttccacgac attccattac
1681 cttggcacgc tggggcagac accggaactc cacactgtgaa caacaaagaa gcactggtag
1741 agttcaagga cgcacatgcc aaaaggcaaa ctgtcgtggt tctagggagt caagaaggag
1801 cagttcacac ggcccttgct ggagctctgg aggctgagat ggatggtgca aagggaaggc
1861 tgtcctctgg ccacttgaaa tgtcgcctga aatggataa acttagattg aagggcgtgt
1921 catactcctt gtgtaccgca gcgttcacat tcaccaagat cccggctgaa acactgcacg
1981 ggacagtcac agtggaggta cagtacgcag ggacagatgg accttgcaag gttccagctc
2041 agatggcggt ggacatgcaa actctgaccc cagttgggag gttgataacc gctaaccccg
2101 taatcactga aagcactgag aactctaaga tgatgctgga acttgatcca ccatttgggg
2161 actcttacat tgtcatagga gtcggggaga agaagatcac ccaccactgg cacaggagtg
2221 gcagcaccat tggaaaagca tttgaagcca ctgtgagagg tgccaagaga atggcagtct
2281 tgggagacac agcctgggac tttggatcag ttggaggcgc tctcaactca ttgggcaagg
2341 gcatccatca aattttggga gcagctttca atcattgtt tggaggaatg tcctggttct
2401 cacaaatcct cattggaacg ttgctgatgt ggttgggtct gaacacaaag aatggatcta
2461 tttcccttat gtgcttggcc ttagggggag tgttgatctt cttatccaca gccgtctctg
2521 ctgacttcgg atgtggattt gacccagata ggaaggtagc acagtgtggt tctggctcat
2581 tcgtgtggaa gtcactggcc cgttggccaa tgctgatca cgccattgag tttgaagata
2641 gcaaagtgat ggtgacttac ttgactgacc tattgatgag aaagaacaaa gtctgcatag
2701 tgtgtgaaga tgtattgcag tgtccgcag cgcgtggagt tgtcgagcag ataacgtcga
2761 tcaatggaat cccaatccat cacaacatgt cgctgtcgca tggccgatat tcccacgtg
2821 tagtgaagaa agtacacaat gttaatgtgg gaaaagccat gttgcgcctt gcaatggcca
```

FIG. 97

2881 catatgcggg agcgatgcct gagagtggat tgggtgtttt gaagacgggg tatttttcac
2941 gcggagaagt gcaggaaacg tgggatgata aagttctaag agtcctaacc agcgccataa
3001 atgcagagga agtgtgccag acagctgtca cgttccagta tgagttcgtt cgatataacc
3061 ggaaagtctt tggatctaac atcgtgttgc gaccttcagc ctttacgagc aaagcttgcc
3121 caacatattt agctggggct gtggtcaaaa acgacatagc aacgtttacg gacggaatga
3181 tgtggatgcg gagccggaaa gtcaatgaaa cgtgggaact gtttgagttg gaaacaactc
3241 aaagccacca atgcatttgg ccatacgcgt acacaataga cctagcaaca cccacggaca
3301 agaggctttt catgccgcca caatacggag gaccaatttc gtttgcgaac catgtgcctg
3361 gattccaggt gcaagaggac tttccctggc agaaggcgaa tatattaatg cgccagggac
3421 cggttccggg aacgaccgta gtccaggatc cacactgtga tgaccgaagt gcggcagtgc
3481 cagtcgaacc aactatgcaa gcttggtgct gcaagacctg ttttgataga ggagtgaagc
3541 ctttccattt tgtggttgac gggaaatttt tctatccaat ggaagtgcgg ccaatgaaac
3601 tggaacaaga cgctgtggtg attgagactg atgatggaga gttcgagagg agtgagcatg
3661 agagcttgtt tgaaggcaaa gcaaagtgga catcaccatt gccaatggga gaaacagcca
3721 agatccaaaa ttttttcgtg accagcccgc caaagccgga atcaagcctg cttctggtgg
3781 gcgttctgat tcatatgtta acaacgcgaa cccgccatcg gtgggcagct cgttgtgctg
3841 gaacttggct catcttcttg gtctttggac atccggttgt gtcttcggtg cagtcttggg
3901 cgtggctctt tatgtcagct gccttagcaa gtgtccctgg tggttcttca ctggtgatcc
3961 acttctggat tgggttgcag atatcgtcag cgcacctctt ttacctgggt tggttaatga
4021 ggaaacgcct gttgatcaca gagatgtcgc gagtggcaca tctgattgcc cagttgtgca
4081 gcttcgagac atatgcgtgg gcaccgatcc tcaaagtact ggatcacttg ctgtttccac
4141 tctacactct gtcagtattc gtcgttcacc agcagtttca ggtattccac gacttgtggc
4201 tacagagcgc cgtggtgatg gcacacctgt tgcaacaccc tctcagtggt ttaataacct
4261 tgagtttaag cgtcggcttg attcagctaa tagcaccaat gaaaagatgg ttttgctcac
4321 cagttatatg gggagatggc ttacgcgcgc cgagaccaca ctggacagcc ttaacgtatt
4381 tcatcgtgct gtatttggca gccgctggga tggagacagt gggtctgcac acgtccggga
4441 tgacagtgat gctgggcggg atgcttctgt gggttgtcct acagttgatg cccccgacag
4501 ccttggaact tgtgcgccta ccgggacaaa gtctgccaga cggatgtgaa gaagaagcgt
4561 caacatctct accagaagga atgagtgggc attacgcccc cgatggagtt gaactcgtga
4621 actacacaga tgcagggact gtctccgcaa accttgtggt atttgttggg tgtgctggaa
4681 ttatgactat gaacatatac gttgggttgg ttatcacggc cttggcctgg gtaacggacg
4741 ccccgatgtg gattccaaga ttgattgatg gtgctatgtc ccagcgggca aattcggagt
4801 tattactgcc atccccacct cttgagatac acaagacgga agactcgttt ggttacatcc
4861 cggacggaac atatcacgtg ttggctagca gctggatgag caagaaacca gttggtgttg
4921 gagtggtgaa ggagggcgtg tttcacacgt tacaccacgt caccaaagga gctaatgtga
4981 catgggcagg acgtgaggtt aggatgcact ctggagatgt taggcgggat attgctgcct
5041 atggcgggcc ctggaacatc agcgggagtc ttgaagatgt cgtagtagtg aaggccgtga
5101 acaaggatgg aaccgtgaca tgctgccgga ttacaacagc taagttggac attgaaggaa
5161 ctacagtgat ggctgttgag cgagattttg gtttcggctc ttcggggtcc cccatatacg
5221 ctcctgatgg acggttgatt ggcttgtatg gatacgggtt ttactatgga acgtacttct
5281 caatagtttc aacaggagaa ggagtggagg caccaccgga agaggttgaa gtctcaacac
5341 gtgagtttgt ggactggcac cctggaagag gaaaaacgcg cacgatactc gttgagcagg
5401 ccctgaagca tatagctgat ggaaagaggt tgctaatttt gacaccaacg cgggtcgtaa
5461 aggatgaagt gcagcgagcg ataaaggaag ccgccccgca ggcggttatc ggatcgaact
5521 taagcatttt tcggaagaac gccgttacct tggcatgcca cgcgaccttc acgcagtatg
5581 tgatggagaa ggggatagaa agtgtgaagt tttcgactat cattatggac gagtgccact
5641 ttctggaccc gatgtccatc gcgtgccgcg ggataatgga tttccacaat agccgtggaa
5701 cgaaggtcat cttcatgagt gcgacgcccc caggacgagc aggaaacgct gggtccaact
5761 ttacgataga agacagagcc attaagttcc ccaaggagtt gaccgcatcg tggatcaaag

FIG. 97 cont.

5821 agaagtcaat aggcaagacc atcgtttttg tgccaacaat tacgcaagct gtgaggctgg
5881 ctaaagagct gggaggggtg gccttgaccc gagatacgtt caatgatgcc atggggaagg
5941 cccggagtcc ggaaacaatg tttataatct caacagacat tagcgagatg ggagccaacc
6001 tcggagtgac tactgttatc gacacaagaa ctgttataaa accattagta tctgacaaag
6061 gagtttcact tgaaagggtt ggtgtgaccc cagcttcaat catccagcgc aggggtcgag
6121 ttggtcgacg agagcccgga gtatacattt atcccttga cgtcgaacca gaggagcagc
6181 cagaaaattg ggtgtgttgg gtggaggcgc aaatgatcct agatcaattg ggctgccatc
6241 cgatgagaga ggagagcgaa ttttccgcc cgcaaggcac gtaccggatt gacgacgttg
6301 agcagcggag gtttctcggg ttgatcaagg aaaaactgcc aatttggctt gcttggactt
6361 gggctagctc acatgcgaac aaacatcaga tgctatttca gggaaacgcc cccaacactg
6421 gacgaacatt aaaaataaag acgccatccg gatctcacat ttacgcccca aaggtgacag
6481 atgataggtt tgaaaaggag ccagaaattg tgaaagtggc ggccatcgga ttcttcctaa
6541 agcagagatc actacacttc gacttacctg gattattgac cggattgtac acggtgttga
6601 caacggctgg gctcgatgcc cttggaaatt cgttcaaacg ctctgtggac acccttcacg
6661 acatcggaaa tgcggtggaa ggagagtttt ctgctataca aatgggacgg attttacaga
6721 tgtggtctgc gttgtttatc ggggtgactt tgggagttgt gctgatggga gccggatttg
6781 ttgtggtgaa ggcttttaga ggattgtttg gaacccgcca acaacacaca actgtgtgcg
6841 tgtcggaggg cggaagtttc caaaaagttg ccacggttct aatgagcgtt ggaccattgt
6901 gcgccgtttt tggtggcatt ccctctatat tcgtcttcat tgtgaccgtt gccctgttga
6961 ttgtgctgtg tgtgggcgga ggtggctctc aacgtggtgt gcttgattcg gatctaatac
7021 gctgggtcat ggtgttggcc atgatgacaa tcggagtgac tgcgtgggag ttggagctat
7081 taccaaacgt gagaagagat gttatacagt tgactcgata cctgtttgct agcaatcctg
7141 ccgttgttgg agctgtgttt aacgccggga atatcggatt gggagtctct ctgccaggga
7201 ccctcatgat gagctacgcc gcgagcgaa cgctggcccc ccttattgga gcgtgggccg
7261 aaggaaattt cttaggaaag ctctttggta gcgaagtgct tccagctcag gctataggcg
7321 gatttcaagt gacagctatc ccgtggggat ctatggtgcc ggttatcgct ggttgctttc
7381 tagcgacaaa cactctttcg aaagtgtttg gtgctggaat tacaactgtg tttctcatac
7441 tactctactt cgacaagaaa catgcattca cgaacaaggc tgttaaggtt ttgttggcgc
7501 ggacaaacag aagggacatg gaggaagaaa tcacaacaag ggacgcggag tcgcgggctc
7561 gccaactgtt ttatggccta caactggccg tatcgttgct gtgggttctc tcacatcctg
7621 tgttggaaaa cttcgttcca ttctttgctg tgtgcgggta cacattcctg tcgctcttga
7681 ggccaaatca tcaactacat gctgcgttgg attatacatt ggtagtcctg ctcttgcagg
7741 tagttgaacc tgggaacatc atgtacgtcg gyggatgcgt tttgytatgg tatgttytaa
7801 accctaccag attgggcgtg cgctcgctgg tgaagagtga caccggaggt ttaggcttcc
7861 gttggaagaa agcgttgaat tcacttagtg agaggcagtt tgccatctac aaagtcagag
7921 gcgtgaatga aactgataaa ggagcctacg tgtcgcgagg tggtttaaaa atgaacgaga
7981 ttatcaacaa gcatgcatgg ggaaccccgag gagttgtcgt tgacctagga tgtgggcgag
8041 gaggctggtc ccagcgcttg gtgatggatt accgcgtcgc tgaagtaaga ggatacactc
8101 ttggaggcaa agaacgtgag aatccccaac cgttccaaac gaaaggatac aacttggcga
8161 atttgaaggc tggagttgac gtctacaaaa tggagccagt gaattgcaac accattattt
8221 gcgacatagg tgagagtgac ccacgccctg aagttgaaaa gacacgaacg ctgaaggttt
8281 tgggaatgct agagaaatgg ttggaagtca atccaaacgc ctcttttgc tgcaaagtgc
8341 tgtcgcctta tcacttggac gtgcttcgaa agttagagtc gctgcaacac aagtataatg
8401 gacggctggt tcgattgtct tacagtcgga actcaacagc agaaatgtat tacgtgtcag
8461 gaaagagagc aaacgtggtg gcaagcgtgt acttcatgct cgggtcgctg gtaggtaggc
8521 tgcggagaca tgagccatca atcatcgacc cccgccagt tctagagatg ggaaccagaa
8581 gcgatccgcg ggcaaaggcg aaagcgcaag acttcgagat gatccgaagg agagtagaac
8641 gattacgagg agaaaaccgg aaaacatggt tgtagacaa cgaacatcca tatgtgtcat
8701 tcaactacca tggatccttc gtgactgatg aggtgacagc gggcggacaa acgacaaatc
8761 ccttgattag acgcgtcatg tggcatgggg actttctgtc tcgggtgaca accttatga

FIG. 97 cont.

```
8821 tgaccgatgt ttcaacgtac gcccaacaaa aggtgctgcg tgaaaaggtg gacactgtct
8881 ctgaggagcc cgacgagcga atgaaagcaa ttaacaggct tatcatgaca cacttcgtaa
8941 aaatgttcaa gcggcgcggg ctgaaaccga gggtgttgac accacaagac tacatgaata
9001 atgtccaagc caacgcagcc ataggaggat ggagcgaagt gatggattgg caaaacgtgc
9061 gcgatgcttt ggcagatcaa cgattttggg acatggtaga taacgagaga gccttacact
9121 tgcgtggtga ctgtgagctt tgcatttata acacgatggg aaagaaggaa aagaagccat
9181 ctgcctttgg cactgcgaaa ggttcacgca ccatctggta tatgtggctt ggaagccgtt
9241 atttagagta cgaggcttta ggattcttga acgaagatca ttgggttgca cgagaaaact
9301 ttccatgtgg agtcggtggc gtcggtgtta attattttgg atattatctg aaggaaatag
9361 ccgagggagg ccgatggtta atcgcagacg acgtcgcggg atgggacacg agaataaccc
9421 aaggagatct agatgacgag ctgttcatgt taactgagct tgccccaacc acataccaca
9481 agaaattgat aactgcgaca atgacgttgg cttataaaaa catagtggcc ttattcccta
9541 gaaatcatcc gatgtaccga agtggaaccg ttcttgatgt gttgtctcga acggatcagc
9601 gtgggtcggg ccaggtgaca acatacgctt tgaacactgt gactaatgga aagtgccagg
9661 tcgggagaac attagaagcg tgtggcttgc tggacgcccc gctcaccaca atcgactcct
9721 ggctcactgc caacttggaa cgagttcttg gatcaatggt cgttgccgga gatgatgtgg
9781 tagtggcgac agacaatgaa gaattccaca cgagtttgag atacataaca gcgacgtcaa
9841 agatccgaaa gaacttaggg gtgagtgagc catcgccgag attcacgagc tgggaagatg
9901 ttgagttttg ctcacaccac ttccatccac tgacgttacg tgatggccgt gtgctgatcg
9961 ccccgtgtcg tgaccaaaac gaaattatcg gaagatcaag aatccagaaa ggcggaatag
10021 ttgacatggc ctcggctggg tgcttagcga aggctcacgc gcagatgtgg gccctttact
10081 tcttccatcg gcgagactta cggattggat tcgcggccat cacatcaatt gtgcctatca
10141 actgggtgcc gacgggtagg atatcatggt ctattcacca gaacgcagag tggatgacga
10201 ctgaggatat gctaacggtt tggaacaacg tgtggattag ggacaatccg tggatgagag
10261 gaaaagaacg agtgacttca tggacagaca taccgtattt acccaaagga gtggacataa
10321 agtgcggaag cctaataggc gattccgacc gcgcttcctg gtcaaagacg attcccctag
10381 ttgtggagaa gacccgaaaa atccttgagc aggagagggg aacattgaag ttctacaatg
10441 ggttatccat tctaggacgg tatgttcacc acgtcgatcc tgtgttcaac tgaagtgtga
10501 cgaygtaggc ccgcgggagc cttagaattc aagwgcttgg raattctaga atcccgttta
10561 ccgcaggagg gggtcatatg gagcaggtgg ctatgtatag cctggctaaa tgtatggctc
10621 ctgggggagt racgcccctc cggttccagt tcctgggtga acaggtaaaa accaccacga
10681 agcgccgctt caacatcgca aggggggagaa atcccgggtg ctgacgccac cccgaccccca
10741 gtcccacata aggctgtgac gaaaragcct taccggcacg aggagtgccc accgcaagga
10801 ggagaaatcc tgggcgttga cgacgcyccg gccccagtct ctgataggtg accagaacca
10861 tgtcacccca aagtgttgaa aggacactga tcaccagaaa tggtgagggc acacagggct
10921 tagcccaagg tgagtgacga cacctcccga aatgtgtaaa tagcagggtc agctctaagc
10981 agcaggcttc caccgttagg aagcgttgct gtgagcttac ttggctacgt ct
```

FIG. 97 cont.

SEQ ID NO:402 PaRV/KRBV-prM

```
   1 msglggllpl rgkkkkapvi qsqgrvlpks dwkgapkqdl nkkkakkdet kgqnwprrin
  61 prtgqwsaie gsgarlwrsi fstdliggll lliailsnly ekvrrditel krrvtrleks
 121 rasliltpmv llclailaag ktmngimdkg ehvwkadwnv dftnvklpkd fcgsgihvek
 181 mcpqvdslqd atidcagrhd qfllsytrca aknrvkrgep gvvepkvtni wtitfndeln
 241 siiervsgml knnrlmatav iclvgafkkw ptwlvvllvl lpwtvvqaef vepflvlkhd
 301 hstmlmtrly pgeiahvatp aglvdirvsh aqifggqrfr ellsdcsvna systdicpgg
 361 sqldlesikg pgrvcmtapy nrgwgtgcfk wgigavatcv elnctretkv dlltnsaiva
 421 nvtvnfhstn dtkllvpdtp itlkfgklgt mtmtcrlgnd riandfyhvt dniasglfqk
 481 alidawegps kmanhisghe kvvkwghilp neikvskiie meldwekait thdgfsntyf
 541 wcqvavnklv vgsfascksg akasfiqssw gfdgvvevtl deatkticsl pltctgcsll
 601 atkvvflegs qravghvgcg ngtsmltvgt tkvgiqcvvt pvsqiwnfvt hasgryaklg
 661 fggvggafhd llvkvgltft wdswkiitvl sglvvafaif drklviliii lcgiaytrad
 721 igcgidfdrk tytcgsglfv wkglgkypta dhsvefasyd flsaylqeqf ksekkvciic
 781 edivqceaar kaaaavyknl ghpfvyvnts dsygkvfaei pkrvhtvsvg vdvvemammt
 841 renkpvgpfg dlprsmvswk sipeteehpv lrvltsssdy qkvcgkaigf qydfvgyrrt
 901 mygsnvqlki skkvsiecpt ylagvavknd rtvftdgmfw msskrengty aitelemeqs
 961 hkciwpdqyt pdatltprdn emfvppewgg pmskanhipg ykmqtgfpwn kapirfvegs
1021 vpgtivtqis hcdgrgiaae vnpatqpnwc cksctrifhf evdgklyypm eirpdpkgge
1081 qqkvpvvetp igdeetetvg gwlgrmynip gaegsyadfr lpklpnsrps amvgslvnll
1141 clmfsiqivt ktmrartlmr fylcclvfmf fgmptlfgls gflawmmilp ishnsvtmcn
1201 ltvhlwavll nqssamflwg ltlrsqiqrs tagqmllftm qmlhhaiyah swvfgwviev
1261 clsvglmmnl ltvidtvhpk liayllffgw ktgmcvvcaw lliysirrwn sivaaapaag
1321 gwrsgyrtmm ssslivifis vgiagviasd yggypaaaav taallimgik mfdflttrls
1381 lefvsagmfp egvekafepd svsdlfrasf tvdgiklqdh vepipilfai lyifigavac
1441 kvnpalgivy aiamfatplp elmrlymmti ysstfrtdtl lgmaipetep elsqdfgpip
1501 dgiyrvnnhg fsvkshrgvg ivkngvfhtl mhvtlnepla wqnrlvgpsm ghslkdyvty
1561 ggnwqlpdfd ivnevgimvc grdrsiqykr hevgtimidd krvmyfthdy ghgssgspif
1621 vngepvalyg fgfhlynryr sivlpipree vldgasnegi paehgtmrnk ffvdwhpgkg
1681 ktrkvivkev lnalnlarri vvlaptrvvl aeitkaigen tsktpsknla ftghnivtva
1741 chatftdyvl rhglskfkah evimdechfl dprsiaargi lehlatkrgv kvtfmsatip
1801 grepslgsnf eiseqalqfp rdvnqrwiet vargktvafv pshrvgdkla rgcpqaislh
1861 rnnfdtnyst amdesikfiy ttdisemgan fsadtvidfr vaikpkisse favtleptpi
1921 trssmiqrrg rvgrqrpgty iypvdkgved asdqlacwte aqmlldqldl tmmaeevrqs
1981 nipgayklvg rsldifrkll ekddipiwls wkwadsvqqq ysilfegerq envarvvntr
2041 dyasleykpk fvdarferlg wdqrklsiqf ymntrsfitf atlshvisqv ieagvvnsaw
2101 krigdvsiif teggdphakd etimawtilv ggvlgalgfl ivawgmkavl rvifgsrdkh
2161 lsvptlvadf qpyivcivpi alhlagvpip mtivffamlf ltyplmyksa gqrsyvdidl
2221 vkwillggci vtgvicwemr llpnissdis ailnrqrqre dtptfdaspp wewldlaqpv
2281 phnveltsvv ittfttwlfl hqivgwsyes ewlksyfdhk gvgqimggfr ldtiswgsal
2341 sgllgtatya swgailtglg gavvyfflmv smlkwnfsgg attglennvm rndretglgn
2401 rpandnrrsl lygvvaaecl vwlfcfrtat daivvaclvs yclwiinnpa sphhkntdlg
2461 sacsfiglly ctcptqkciq vlmrfalarl nmntrsleks atgglghrwk kllnamtlle
2521 fnayrscgvd etekgdyvsr gglklreitm kygwkpegic vdlgcgrggw sqhlamdprv
2581 trvesftlgg tarenpqpik tlghnlirfk sgvnvynmtp thantivcdi gesdpkpeve
2641 tsrtlrvlkt lelwlarnpn aefvckvlcp ypvevlkcle tlqhkyggri irstysrnss
2701 aemyyisggr nnmvkviftt lhslisrirt rpekivkesv slpvgtrsdp ghkiksmdpk
2761 miatrvekik kehadtwfvd nnhpyqsfry vgsyvtddvt pggqtvnplm rkmmwpwetv
2821 ggvvnfmmtd vstyaqqkvl rekvdtlspe ppndiqrvnr witeflcasf mrrglkpril
2881 tmeqyinnvk ssaaigswss dvpwssvrea ladkrfhqmv eeerklhlag dcrmcvyntm
2941 gkkekkpsam gvakgsrtiw ymwlgsrfle yealgflned hwvsrdnlac gvggvgvnyf
3001 gyylqeiark gkffiaddia gwdtrinesd ladeeflims licdpyhrsl akavfrfayq
3061 nivalfprnh pgfgsgtvmd vvartdqrgs gqvvtyalnt itnakiqlgr mleaegllda
3121 hehvikkwln dngeealsgm vvagddvvva tnngnfsrsl rylhlngkir kdidpslpsk
3181 vetnwevvef cshhyhvmtl kdgrriivpc reqneiigrg riqkgglvtl aesaclakay
3241 gqmwalyffh rrdlrmafla itssvpidwf pegrtswsih qnkewmtted mlrvwntvwi
3301 qdnpwmedkm eienwrdipy lpksmdlkcg sligtkeraa wskdlpstvt avrkiidqdt
3361 ktenvyqdfl ggmgrfqtyt dpmat
```

FIG. 98

SEQ ID NO:403  PCV/ZIKV-prME P1

```
   1 lslvlikrlq lptsmylipl mnqergilrg mgrfppppvk kgnknsvava rvppqqggka
  61 reknrerika pgarhgvagk mkslmgelgf gwidllrvdl vegimmmvfv iqrafaqvhr
 121 rirglsrrvr alekkrdgra amfiwtilam lfgvmgaevt rrgsayymyl drndageais
 181 fpttlgmnkc yiqimdlghm cdatmsyecp mldegvepdd vdcwcnttst wvvygtchhk
 241 kgearrsrra vtlpshstrk lqtrsqtwle sreytkhlir venwifrnpg falaaaaiaw
 301 llgsstsqkv iylvmillia paysircigv snrdfvegms ggtwvdvvle hggcvtvmaq
 361 dkptvdielv tttvsnmaev rsycyeasis dmasdsrcpt qgeayldkqs dtqyvckrtl
 421 vdrgwgngcg lfgkgslvtc akfacskkmt gksiqpenle yrimlsvhgs qhsgmivndt
 481 ghetdenrak veitpnspra eatlggfgsl gldceprtgl dfsdlyyltm nnkhwlvhke
 541 wfhdiplpwh agadtgtphw nnkealvefk dahakrqtvv vlgsqegavh talagaleae
 601 mdgakgrlss ghlkcrlkmd klrlkgvsys lctaaftftk ipaetlhgtv tvevqyagtd
 661 gpckvpaqma vdmqtltpvg rlitanpvit estenskmml eldppfgdsy ivigvgekki
 721 thhwhrsgst igkafeatvr gakrmavlgd tawdfgsvgg alnslgkgih qifgaafksl
 781 fggmswfsqi ligtllmwlg lntkngsisl mclalggvli flstavsadf gcgfdpdrkv
 841 aqcgsgsfvw kslarwpmad haiefedskv mvtyltdllm rknkvcivce dvlqcaaarg
 901 vveqitsing ipihhnmsls hgryfprvvk kvhnvkvgka mlrlamatya gampesglgv
 961 lktgyfsrge vqetwddkvl rvltsainae evcqtavtfq yefvrynrkv fgsnivlrps
1021 aftskacpty lagavvkndi atftdgmmwm rsrkvnetwe lfelettqsh qciwpyayti
1081 dlatptdkrl fmppqyggpi sfanhvpgfq vqedfpwqka nilmrqgpvp gttvvqdphc
1141 ddrsaavpve ptmqawcckt cfdrgvkpfh fvvdgkffyp mevrpmkleq davvietddg
1201 efersehesl fegkakwtsp lpmgetakiq nffvtsppkp esslllvgvl ihmlttrtrh
1261 rwatrcagtw liflvfghpv vssvqswawl fmsaalasvp ggslvihfw iglqissahl
1321 fylgwlmrkr llitemsrva hliaqlcsfe tyawapilkv ldhllfplyt lsvfvvhqqf
1381 qvfhdlwlqs avvmahllqh plsglitlsl svgliqliap mkrwfcspvi wgdglraprp
1441 hwtaltyfiv lylaaagmet vglhtsgmtv mlggmllwvv lqlmpptale lvrlpgqslp
1501 dgceeeasts lpegmsghya pdgvelvnyt dagtvsanlv vfvgcagimt mniyvglvit
1561 alawvtdapm wiprlidgam sqranselll psppleihkt edsfgyipdg tyhvlasswm
1621 skkpvgvgvv kegvfhtlhh vtkganvtwa grevrmhsgd vrrdiaaygg pwnisgsled
1681 vvvvkavnkd gtvtccritt akldiegttv maverdfgfg ssgspiyapd grliglygyg
1741 fyygtyfsiv stgegveapp eevevstref vdwhpgrgkt rtilveqalk hiadgkrlli
1801 ltptrvvkde vqraikeaap qavigsnlsi frknavtlac hatftqyvme kgiesvkfst
1861 iimdechfld pmsiacrgim dfhnsrgtkv ifmsatppgr agnagsnfti edraikfpke
1921 ltaswikdks igktivfvpt itqavrlake lggvaltrdt fndamgkars petmfiistd
1981 isemganlgv ttvidtrtvi kplvsdkgvs lervgvtpas iiqrrgrvgr repgvyiypl
2041 dvepeeqpen wvcwveaqmi ldqlgchpmr eeseffrpqg tyriddveqr rflglikekl
2101 piwlawtwas shankhqmlf qgnapntgrt lkiktpsgsh iyapkvtddr fekepeivkv
2161 aaigfflkqr slyfdlpgll tglytvltta gldalgnsfk rsvdtlhdig navegefsai
2221 qmgrilqmws alfigvtlgv vlmgagfvvv kafrglfgtr qqhttvcvse ggsfqkvatv
2281 lmsvgplcav fggipsifvf ivtvallivl cvggggsqrg vldsdlirwv mvlammtigv
2341 tawelellpn vrrdviqltr ylfasnpavv gavfnagnig lgvslpgtlm msyaasgtla
2401 pligawaegn flgklfgsev lpaqaiggfq vtaipwgsmv pviagcflat ntlskvfgag
2461 ittvflilly fdkkhaftnk avkvllartn rrdmeeeitt rdaesrarql fyglqlavsl
2521 lwvlshpvle nfvpffavcg ytflsllrpn hqlhaaldyt lvvlllqvve pgnimyvggc
2581 vllwyvlnpt rlgvrslvks dtgglgfrwk kalnslserq faiykvrgvn etdkgayvsr
2641 gglkmneiin khaweprgvv vdlgcgrggw sqrlvmdyrv aevrgytlgg kerenpqpfq
2701 tkgynlanlk agvdvykmep vncntiicdi gesdprpeve ktrtlkvlgm lekwlevnpn
2761 asfcckvlsp yhldvlrkle slqhkyngrl vrlsysrnst aemyyvsgkr anvvasvyfm
2821 lgslvgrlrr hepsiidppp vlemgtrsdp rakakaqdfe mirrrverlr genrktwfvd
2881 nehpyvsfny hgsfvtdevt aggqttnpli rrvmwpwdfl srvttfmmtd vstyaqqkvl
2941 rekvdtvsee pdermkainr limthfvkmf krrglkprvl tpqdymnnvq anaaiggwse
3001 vmdwqnvrda ladqrfwdmv dneralhlrg dcelciyntm gkkekkpsaf gtakgsrtiw
3061 ymwlgsryle yealgflned hwvarenfpc gvggvgvnyf gyylkeiagg grwliaddva
3121 gwdtritqgd lddelfmlte lapttyhkkl itatmtlayk nivalfprnh pmyrsgtvld
3181 vlsrtdqrgs gqvttyalnt vtngkcqvgr tleacgllda plttidswlt anlervlgam
3241 vvagddvvva tdneefhtsl ryitatskir knlgvsepsp rftswedvef cshhfhpltl
3301 rdgrvliapc rdqneiigrs riqkggivdm asagclakah aqmwalyffh rrdlrigfaa
3361 itsivpinwv ptgriswsih qnaewmtted mltvwnnvwi rdnpwmrgke rvtswtdipy
3421 lpkgvdikcg sligdsdras wsktiplvve ktrkileqer gtlkfyngls ilgryvhhvd
3481 pvfn
```

FIG. 99

SEQ ID NO:404 PCV/ZIKV-prME P10

```
   1 mnqergilrg mgrfppppvk kgnknsvava rvppqqggka reknrerika pgarhgvagk
  61 mkslmgelgf gwidllrvdl vegimmmvfv iqrafaqvhr rirglsrrvr alekkrdgra
 121 amfiwtilam lfgvmgaevt rrgsayymyl drndageais fpttlgmnkc yiqimdlghm
 181 cdatmsyecp mldegvepdd vdcwcnttst wvvygtchhk kgearrsrra vtlpshstrk
 241 lqtrsqtwle sreytkhlir venwifrnpg falaaaaiaw llgsstsqkv iylvmillia
 301 paysircigv snrdfvegms ggtwvdvvle hggcvtvmaq dkptvdielv tttvsnmaev
 361 rsycyeasis dmasdsrcpt qgeayldkqs dtqyvckrtl vdrgwgngcg lfgkgslvtc
 421 akfacskkmt gksiqpenle yrimlsvhgs qhsgmivndt ghetdenrak veitpnspra
 481 eatlggfgsl gldceprtgl dfsdlyyltm nnkhwlvhke wfhdiplpwh agadtgtphw
 541 nnkealvefk dahakrqtvv vlgsqegavh talagaleae mdgakgrlss ghlkcrlkmd
 601 klrlkgvsys lctaaftftk ipaetlhgtv tvevqyagtd gpckvpaqma vdmqtltpvg
 661 rlitanpvit estenskmml eldppfgdsy ivigvgekki thhwhrsgst igkafeatvr
 721 gakrmavlgd tawdfgsvgg alnslgkgih qifgaafksl fggmswfsqi ligtllmwlg
 781 lntkngsisl mclalggvli flstavsadf gcgfdpdrkv aqcgsgsfvw kslarwpmad
 841 haiefedskv mvtyltdllm rknkvcivce dvlqcaaarg vveqitsing ipihhnmsls
 901 hgryfprvvk kvhnvnvgka mlrlamatya gampesglgv lktgyfsrge vqetwddkvl
 961 rvltsainae evcqtavtfq yefvrynrkv fgsnivlrps aftskacpty lagavvkndi
1021 atftdgmmwm rsrkvnetwe lfelettqsh qciwpyayti dlatptdkrl fmppqyggpi
1081 sfanhvpgfq vqedfpwqka nilmrqgpvp gttvvqdphc ddrsaavpve ptmqawcckt
1141 cfdrgvkpfh fvvdgkffyp mevrpmkleq davvietddg efersehesl fegkakwtsp
1201 lpmgetakiq nffvtsppkp esslllvgvl ihmlttrtrh rwaarcagtw liflvfghpv
1261 vssvqswawl fmsaalasvp ggsslvihfw iglqissahl fylgwlmrkr llitemsrva
1321 hliaqlcsfe tyawapilkv ldhllfplyt lsvfvvhqqf qvfhdlwlqs avvmahllqh
1381 plsglitlsl svgliqliap mkrwfcspvi wgdglraprp hwtaltyfiv lylaaagmet
1441 vglhtsgmtv mlggmllwvv lqlmpptale lvrlpgqslp dgceeeasts lpegmsghya
1501 pdgvelvnyt dagtvsanlv vfvgcagimt mniyvglvit alawvtdapm wiprlidgam
1561 sqranselll pspplelhkt edsfgyipdg tyhvlasswm skkpvgvgvv kegvfhtlhh
1621 vtkganvtwa grevrmhsgd vrrdiaaygg pwnisgsled vvvvkavnkd gtvtccritt
1681 akldiegttv maverdfgfg ssgspiyapd grliglygyg fyygtyfsiv stgegveapp
1741 eevevstref vdwhpgrgkt rtilveqalk hiadgkrlli ltptrvvkde vqraikeaap
1801 qavigsnlsi frknavtlac hatftqyvme kgiesvkfst iimdechfld pmsiacrgim
1861 dfhnsrgtkv ifmsatppgr agnagsnfti edraikfpke ltaswikeks igktivfvpt
1921 itqavrlake lggvaltrdt fndamgkars petmfiistd isemganlgv ttvidtrtvi
1981 kplvsdkgvs lervgvtpas iiqrrgrvgr repgvyiypl dvepeeqpen wvcwveaqmi
2041 ldqlgchpmr eeseffrpqg tyriddveqr rflglikekl piwlawtwas shankhqmlf
2101 qgnapntgrt lkiktpsgsh iyapkvtddr fekepeivkv aaigfflkqr slhfdlpgll
2161 tglytvltta gldalgnsfk rsvdtlhdig navegefsai qmgrilqmws alfigvtlgv
2221 vlmgagfvvv kafrglfgtr qqhttvcvse ggsfqkvatv lmsvgplcav fggipsifvf
2281 ivtvallivl cvggggsqrg vldsdlirwv mvlammtigv tawelellpn vrrdviqltr
2341 ylfasnpavv gavfnagnig lgvslpgtlm msyaasgtla pligawaegn flgklfgsev
2401 lpaqaiggfq vtaipwgsmv pviagcflat ntlskvfgag ittvflilly fdkkhaftnk
2461 avkvllartn rrdmeeeitt rdaesrarql fyglqlavsl lwvlshpvle nfvpffavcg
2521 ytflsllrpn hqlhaaldyt lvvlllqvve pgnimyvggc vllwyvlnpt rlgvrslvks
2581 dtgglgfrwk kalnslserq faiykvrgvn etdkgayvsr gglkmneiin khaweprgvv
2641 vdlgcgrggw sqrlvmdyrv aevrgytlgg kerenpqpfq tkgynlanlk agvdvykmep
2701 vncntiicdi gesdprpeve ktrtlkvlgm lekwlevnpn asfcckvlsp yhldvlrkle
2761 slqhkyngrl vrlsysrnst aemyyvsgkr anvvasvyfm lgslvgrlrr hepsiidpsp
2821 vlemgtrsdp rakakaqdfe mirrrverlr genrktwfvd nehpyvsfny hgsfvtdevt
2881 aggqttnpli rrvmwpwdfl srvttfmmtd vstyaqqkvl rekvdtvsee pdermkainr
2941 limthfvkmf krrglkprvl tpqdymnnvq anaaiggwse vmdwqnvrda ladqrfwdmv
3001 dneralhlrg dcelciyntm gkkekkpsaf gtakgsrtiw ymwlgsryle yealgflned
3061 hwvarenfpc gvggvgvnyf gyylkeiaeg grwliaddva gwdtritqgd lddelfmlte
3121 lapttyhkkl itatmtlayk nivalfprnh pmyrsgtvld vlsrtdqrgs gqvttyalnt
3181 vtngkcqvgr tleacgllda plttidswlt anlervlgsm vvagddvvva tdneefhtsl
3241 ryitatskir knlgvsepsp rftswedvef cshhfhpltl rdgrvliapc rdqneiigrs
3301 riqkggivdm asagclakah aqmwalyffh rrdlrigfaa itsivpinwv ptgriswsih
3361 qnaewmtted mltvwnnvwi rdnpwmrgke rvtswtdipy lpkgvdikcg sligdsdras
3421 wsktiplvve ktrkileqer gtlkfyngls ilgryvhhvd pvfn
```

FIG. 100

SEQ ID NO:405  PaRV/KRBV-prME

```
   1 ktmngimdkg ehvwkadwnv dftnvklpkd fcgsgihvek mcpqvdslqd atidcagrhd
  61 qfllsytrca aknrvkrgep gvvepkvtni wtitfndeln siiervsgml knnrlmatav
 121 iclvgafkkw ptwlvvllvl lpwtvvqasl adpflilpkg dglvktrlyp gqissisthv
 181 gvldisymav dieegrlver lmshcevngt ysqdccalgc nldlsklner nracqtatyn
 241 rgwatgcpvf glgsvatcve vacsdsvevs eltsqnirip lslrlqheel nvtmtteapv
 301 tskfshhgvv siscqignpg flaqqyvlsn gkhkamfpis avsgwpgire iggqyrnvdg
 361 svkwghvean eikvaavysd siqwktgipi ktgirdplyl ycevsltdlt fkkiracesp
 421 vevsfmagpt gldgrleigl leqvnktcsi tgscegctlp hptsvistsd kkghmhvecr
 481 tgtftaifgk qkfsftcxts ylrtiwatta qaignyrkfg ldasggpfld lwnkigpnfs
 541 rlevvgilvv aallidkrll lllaifgyvt yvradicgi dfdrktytcg sglfvwkglg
 601 kyptadhsve fasydflsay lqeqfksekk vciicedivq ceaarkaaaa vyknlghpfv
 661 yvntsdsygk vfaeipkrvh tvsvgvdvve mammmtrenkp vgpfgdlprs mvswksipet
 721 eehpvlrvlt sssdyqkvcg kaigfqydfv gyrrtmygsn vqlkiskkvs iecptylagv
 781 avkndrtvft dgmfwmsskr engtyaitel emeqshkciw pdqytpdatl tprdnemfvp
 841 pewggpmska nhipgykmqt gfpwnkapir fvegsvpgti vtqishcdgr giaaevnpat
 901 qpnwccksct rifhfevdgk lyypmeirpd pkggeqqkvp vvetpigdee tetvggwlgr
 961 mynipgaegs yadfrlpklp nsrpsamvgs lvnllclmfs iqivtktmra rtlmrfylcc
1021 lvfmffgmpt lfglsgflaw mmilpishns vtmcnltvhl wavllnqssa mflwgltlrs
1081 qiqrstagqm llftmqmlhh aiyahswvfg wvievclsvg lmmnlltvid tvhpkliayl
1141 lffgwktgmc vvcawlliys irrwnsivaa apaaggwrsg yrtmmsssli vifisvgiag
1201 viasdyggyp aaaavtaall imgikmfdfl ttrlslefvs agmfpegvek afepdsvsdl
1261 frasftvdgi klqdhvepip ilfailyifi gavackvnpa lgivyaiamf atplpelmrl
1321 ymmtiysstf rtdtllgmai petepelsqd fgpipdgiyr vnnhgfsvks hrgvgivkng
1381 vfhtlmhvtl neplawqnrl vgpsmghslk dyvtyggnwq lpdfdivnev gimvcgrdrs
1441 iqykrhevgt imiddkrvmy fthdyghgss gspifvngep valygfgfhl ynryrsivlp
1501 ipreevldga snegipaehg tmrnkffvdw hpgkgktrkv ivkevlnaln larrivvlap
1561 trvvlaeitk aigentsktp sknlaftghn ivtvachatf tdyvlrhgls kfkahevimd
1621 echfldprsi aargilehla tkrgvkvtfm satipgreps lgsnfeiseq alqfprdvnq
1681 rwietvargk tvafvpshrv gdklargcpq aislhrnnfd tnystamdes ikfiyttdis
1741 emganfsadt vidfrvaikp kissefavtl eptpitrssm iqrrgrvgrq rpgtyiypvd
1801 kgvedasdql acwteaqmll dqldltmmae evrqsnipga yklvgrsldi frkllekddi
1861 piwlswkwad svqqqysilf egerqenvar vvntrdyasl eykpkfvdar ferlgwdqrk
1921 lsiqfymntr sfitfatlsh visqvieagv vnsawkrigd vsiifteggd phakdetima
1981 wtilvggvlg algflivawg mkavlrvifg srdkhlsvpt lvadfqpyiv civpialhla
2041 gvpipmtivf famlfltypl myksagqrsy vdidlvkwil lggcivtgvi cwemrllpni
2101 ssdisailnr qrqredtptf dasppwewld laqpvphnve ltsvvittft twlflhqivg
2161 wsyesewlks yfdhkgvgqi mggfrldtis wgsalsgllg tatyaswgai ltglggavvy
2221 fflmvsmlkw nfsggattgl ennvmrndre tglgnrpand nrrsllygvv aaeclvwlfc
2281 frtatdaivv aclvsyclwi innpasphhk ntdlgsacsf igllyctcpt qkciqvlmrf
2341 alarlnmntr sleksatggl ghrwkkllna mtllefnayr scgvdetekg dyvsrgglkl
2401 reitmkygwk pegicvdlgc grggwsqhla mdprvtrves ftlggtaren pqpiktlghn
2461 lirfksgvnv ynmtpthant ivcdigesdp kpevetsrtl rvlktlelwl arnpnaefvc
2521 kvlcpypvev lkcletlqhk yggriirsty srnssaemyy isggrnnmvk vifttlhsli
2581 srirtrpeki vkesvslpvg trsdpghkik smdpkmiatr vekikkehad twfvdnnhpy
2641 qsfryvgsyv tddvtpggqt vnplmrkmmw pwetvggvvn fmmtdvstya qqkvlrekvd
2701 tlspeppndi qrvnrwitef lcasfmrrgl kpriltmeqy innvksssaai gswssdvpws
2761 svrealadkr fhqmveeerk lhlagdcrmc vyntmgkkek kpsamgvakg srtiwymwlg
2821 srfleyealg flnedhwvsr dnlacgvggv gvnyfgyylq eiarkgkffi addiagwdtr
2881 inesdladee flimslicdp yhrslakavf rfayqnival fprnhpgfgs gtvmdvvart
2941 dqrgsgqvvt yalntitnak iqlgrmleae glldahehvi kkwlndngee alsgmvvagd
3001 dvvvatnngn fsrslrylhl ngkirkdidp slpskvetnw evvefcshhy hvmtlkdgrr
3061 iivpcreqne iigrgriqkg glvtlaesac lakaygqmwa lyffhrrdlr maflaitssv
3121 pidwfpegrt swsihqnkew mttedmlrvw ntvwiqdnpw medkmeienw rdipylpksm
3181 dlkcgsligt keraawskdl pstvtavrki idqdtktenv yqdflggmgr fqtytdpmat
```

FIG. 101

CHIMERIC INSECT-SPECIFIC FLAVIVIRUSES

This application is the U.S. national phase of International Application No. PCT/AU2017/050973 filed Sep. 7, 2017 which designated the U.S. and claims priority to AU Patent Application No. 2017901093 filed Mar. 27, 2017, the entire contents of each of which are hereby incorporated by reference.

REFERENCE TO SEQUENCE LISTING SUBMITTED ELECTRONICALLY

The content of the electronically submitted sequence listing (Name: 0181 0443 Sequence Listing.txt; Size: 1,564,938 bytes; and Date of Creation: Jan. 11, 2022) is incorporated herein by reference in its entirety.

TECHNICAL FIELD

THE present invention relates to flaviviruses. More particularly, the invention relates to chimeric insect-specific flaviviruses and proteins thereof, and vectors for expressing said chimeric insect-specific flaviviruses and proteins, useful for the production of vaccines and/or diagnostics.

BACKGROUND

The *Flavivirus* genus of the Flaviviridae family encompasses a diverse array of viruses, which are responsible for a number of significant mosquito-transmitted diseases such as West Nile fever and encephalitis, dengue and Zika fever and Japanese encephalitis. These small enveloped viruses contain a ~10-11 kb positive sense, single-stranded RNA genome with a single open reading frame (ORF) flanked by 5' and 3' untranslated regions (UTRs). The viral ORF is translated into a single polyprotein, and post-translationally cleaved into structural (C, prM and E) and non-structural proteins (NS1-NS5).

Many flaviviruses are transmitted between mosquitoes and vertebrates, relying on replication in both hosts for maintaining their natural transmission cycle. However, in recent years, a number of flaviviruses, referred to as insect-specific flaviviruses (ISFs), which replicate exclusively in arthropods with no requirement for a vertebrate intermediate, have been discovered. The advent of improved genome sequencing methods such as deep sequencing, sensitive reverse transcription (RT) PCR assays using flavivirus generic primers and the development of broad-spectrum diagnostic tools, such as monoclonal antibodies (mAbs) to viral dsRNA intermediates, have seen the isolation of several other ISFs from various regions around the world.

Several vaccine types are currently in common use, including those for vaccination against flavivirus infection. These include inactivated and attenuated vaccines. However, current vaccines can be associated with certain disadvantages. For example, inactivated vaccines may induce only a moderate or partial immune response, and require multiple doses or 'boosters'. Inactivation may also modify the antigen or destroy epitopes. Additionally, inactivation treatment can be relatively technically demanding and/or expensive. There is also a risk that the inactivation may be incomplete. Furthermore, while attenuated vaccines typically induce a robust immune response, these can be at risk of 'reversion' to pathogenicity.

In addition to use in vaccines, proteins comprising immunogenic sequences can be used in a diagnostic setting, e.g. for detection of flaviviral antibodies in human or animal subjects. Inactivated and/or attenuated viruses have been used in this context, and can offer advantages over recombinant antigens generated from viral subunits in terms of reactivity, although subunit antigens such as domain III of the flavivirus envelope protein typically confer superior specificity. However, similar issues as described above in regard to vaccines can apply in this context.

As such, there is presently a need for new vaccination approaches, including for immunization against flaviviruses. Strategies offering simpler, more efficient, safer and/or more cost effective vaccine production are also highly desirable. Similarly, there is a need for new approaches for diagnostics for viral infection.

SUMMARY

The invention is broadly directed to chimeric proteins that comprise one or more amino acid sequences of an insect-specific flavivirus and one or more other immunogenic proteins. Suitably, the chimeric protein is capable of forming a virus particle. In certain embodiments the chimeric protein and/or virus particle may be suitable for delivery to a subject to elicit an immune response to a pathogen and/or for diagnosis or detection of a pathogen.

In a first aspect, the invention provides an isolated protein comprising:

(i) an amino acid sequence of a protein encoded by the genome of an insect-specific flavivirus; and (ii) an immunogenic amino acid sequence not encoded by the genome of an insect-specific flavivirus.

Said amino acid sequences may be any suitable amino acid sequence, or encoded by any suitable nucleotide sequence, set forth in FIGS. 1-101 disclosed herein. Said amino acid sequences may be any suitable amino acid sequence, or encoded by any suitable nucleotide sequence, set forth in SEQ ID NOS:1-405 presented herein.

In certain particularly preferred embodiments, the isolated protein of this aspect is or comprises an amino acid sequence set forth in SEQ ID NOS:1-4, or SEQ ID NOS:32, 389, 391 or 395, or a fragment, variant, or derivative thereof.

In embodiments, the isolated protein of this aspect is or comprises an amino acid sequence set forth in SEQ ID NOS:20, 22, 24, 26, 28, 30, 32, 384, 393, 397, or 402-405 a fragment or variant thereof.

In preferred embodiments, the insect-specific flavivirus of (i) is capable of infecting a plurality of different insects. In an embodiment, the insect-specific flavivirus is capable of infecting a plurality of different species of insects. In a preferred embodiment, the first insect-specific flavivirus of (i) is capable of infecting a plurality of different genera of insects.

In certain preferred embodiments, the insect-specific flavivirus of (i) has a native host selected from the group consisting of *Coquillettidia* spp.; *Aedes* spp.; *Anopheles* spp.; *Mansonia* spp.; *Toxorhynchites* spp.; *Aedeomyia* spp.; and *Culex* spp.

Preferably, the insect-specific flavivirus of (i) is selected from the group consisting of Palm Creek virus (PCV); Binjari virus (BinJV); Lilly Creek virus (LiCV); and Bamaga virus (BgV).

In embodiments, the insect-specific flavivirus of (i) may be selected from the group consisting of Parramatta River virus (PaRV), Cell fusing agent virus (CFAV), and Karumba virus (KRBV).

In particularly preferred embodiments, (i) comprises an amino acid sequence set forth in SEQ ID NOS:5-7 or 387, or a fragment, variant, or derivative thereof. In embodiments, (i) may comprise an amino acid sequence set forth in SEQ ID NOS:17-19.

Suitably, the immunogenic amino acid sequence (ii) of the protein of this aspect is of any protein not encoded by the genome of an insect-specific flavivirus that is capable of eliciting an immune response in an animal. Preferably, the immunogenic amino acid sequence (ii) is of a protein encoded by the genome of a flavivirus that is not insect-specific.

In preferred embodiments, the immunogenic amino acid sequence (ii) is of a structural protein of a flavivirus that is not insect-specific. Suitably, the structural protein is selected from the group consisting of a Capsid; prM; and Envelope protein. Preferably, the structural protein is a prM protein and/or an Envelope protein.

In one preferred embodiment, the immunogenic amino acid sequence (ii) is of one or more of an EDI, EDII, and EDIII domain of an E protein of a flavivirus that is not insect-specific.

Additionally or alternatively, the immunogenic amino acid (ii) sequence may be of a non-structural protein of the flavivirus. Suitably, the non-structural protein is selected from the group consisting of an NS1; NS2A; NS2B; NS3; NS4A; NS4B; and NS5 protein.

In certain preferred embodiments, the immunogenic amino acid sequence (ii) is of a vertebrate-infecting flavivirus. More preferably, the sequence is of a mammal, reptile or avian-infecting flavivirus. In one particularly preferred embodiment, the sequence is of a human-infecting flavivirus.

Preferably, the immunogenic sequence (ii) is of a flavivirus selected from the group consisting of Zika virus (ZIKV); West Nile virus (WNV); Dengue virus (DENY); Japanese encephalitis virus (JEV); Yellow fever virus (YFV); tick-borne encephalitis virus (TBEV); St Louis encephalitis virus (SLEV); Murray valley encephalitis virus (MVEV); Duck tembusu virus; Turkey Meningoencephalitis Virus (TMEV); Usutu virus; Sepik virus; Wesselsbron virus; Baiyangdian Virus (BYD); and Sitiawan Virus (SV). In a particularly preferred embodiment, the immunogenic sequence of (ii) is of Zika virus; West Nile virus; or Dengue virus.

In particularly preferred embodiments, (ii) is or comprises an amino acid sequence set forth in SEQ ID NOS:8-10, or a fragment, variant, or derivative thereof.

A second aspect provides an isolated nucleic acid encoding the amino acid sequence of the isolated protein of the first aspect.

The isolated nucleic acid of this aspect will comprise a nucleotide sequence of the genome of an insect-specific flavivirus; and a nucleotide sequence encoding an immunogenic amino acid sequence, wherein the immunogenic nucleotide sequence is not of an insect-specific flavivirus.

Preferably, the nucleotide sequence of the isolated nucleic acid of this aspect that is of the genome of the insect-specific flavivirus is of an insect-specific flavivirus capable of infecting a plurality of different insects. In certain preferred embodiments, said insect-specific flavivirus has a native host selected from the group consisting of *Coquillettidia* spp.; *Aedes* spp.; *Anopheles* spp.; *Mansonia* spp.; *Toxorhynchites* spp.; *Aedeomyia* spp.; and *Culex* spp. Preferably, said insect-specific flavivirus is selected from the group consisting of PCV; BinJV; LiCV; and BgV. In embodiments, the insect-specific flavivirus may be selected from the group consisting of KRBV, PaRV, and CFAV.

In preferred embodiments of the isolated nucleic acid of this aspect, the nucleotide sequence that encodes the immunogenic amino acid sequence encodes a protein of a flavivirus that is not insect-specific.

In preferred embodiments, said immunogenic amino acid sequence is of at least part of a structural protein of a flavivirus that is not insect-specific. Suitably, the structural protein is selected from the group consisting of a Capsid; prM; and Envelope protein. Preferably, the structural protein is a prM protein and/or an Envelope protein.

Additionally or alternatively, said nucleotide sequence encoding the immunogenic amino acid sequence may encode a non-structural protein of a flavivirus that is not insect specific. Suitably, the non-structural protein is selected from the group consisting of an NS1; NS2A; NS2B; NS3; NS4A; NS4B; and NS5 protein.

Preferably, said nucleotide sequence of the isolated nucleic acid of this aspect encoding the immunogenic amino acid sequence encodes an immunogenic amino acid sequence of a flavivirus selected from the group consisting of ZIKV; WNV; DENY; JEV; YFV; TBEV; SLEV; MVEV; Duck tembusu virus; TMEV; Usutu virus; Sepik virus; Wesselsbron virus; BYD; and Sitiawan Virus (SV). In a particularly preferred embodiment, said virus is selected from the group consisting of WNV; Zika virus; and Dengue virus.

In some embodiments, the isolated nucleic acid of this aspect is capable of replicating an isolated chimeric insect-specific flavivirus comprising the isolated protein of the first aspect.

In a third aspect, the invention provides a genetic construct comprising the isolated nucleic acid of the second aspect.

In a fourth aspect, the invention provides a host cell comprising the genetic construct of the third aspect.

A fifth aspect of the invention provides an isolated chimeric insect-specific flavivirus comprising the isolated protein of the first aspect; and the isolated nucleic acid of the second aspect, wherein the isolated nucleic acid is capable of replicating the isolated chimeric insect-specific flavivirus.

In a sixth aspect, the invention provides a vector comprising:

(i) the isolated nucleic acid of the second aspect; and (ii) an insect-specific promoter operably connected to the isolated nucleic acid (i).

In particularly preferred embodiments, the vector of this aspect is or comprises a nucleotide sequence set forth in SEQ ID NOS:11-14 or SEQ ID NOS:33, 388, 390, 398, or 399, or a fragment or variant thereof.

In alternative embodiments, the vector of this aspect is or comprises a nucleotide sequence set forth in SEQ ID NOS: 21, 23, 25, 27, 29, 31, 385, 392, or 396, or a fragment or variant thereof.

In preferred embodiments of this aspect, the isolated nucleic acid (i) is capable of replicating an isolated chimeric insect-specific flavivirus comprising the isolated protein of the first aspect.

In preferred embodiments of the vector of this aspect, the insect-specific promoter (ii) is of an insect virus. In particularly preferred embodiments, said virus is selected from the group consisting of *Orgyia pseudotsugata* multicapsid nucleopolyhedrosis virus (OpMNPV); *Autographa californica* nucleopolyhedrovirus (AcMNP); and *Spodoptera exigua* multiple nucleopolyhedrovirus (SeMNPV).

In preferred embodiments, the insect promoter (ii) is or comprises a nucleotide sequence set forth in SEQ ID NOS: 15-16 or SEQ ID NOS:382-383, or a fragment or variant thereof.

In a particularly preferred embodiment, the insect promoter (ii) is or comprises a nucleotide sequence set forth in SEQ ID NOS:15-16, or a fragment or variant thereof. Preferably, the insect promoter of (ii) is or comprises SEQ ID NO:16.

In certain embodiments, the vector of this aspect further comprises one or more small RNA target sequences, for regulation of replication of an isolated chimeric insect-specific flavivirus comprising the isolated protein of the first aspect in one or more cells, preferably one or more mosquito cells. Preferably, the one or more small RNA target sequences prevent or constrain replication of the chimeric insect-specific flavivirus in one or more cells of the midgut of a mosquito.

In a seventh aspect, the invention provides a method of producing a vector, the method including the step of operably connecting the isolated nucleic acid of the second aspect with an insect-specific promoter, to thereby produce the vector.

In preferred embodiments, the method of the seventh aspect includes the step of joining at least two nucleic acids using a nucleic acid amplification technique, to thereby produce the vector.

In preferred embodiments, the method includes the step of joining a nucleic acid comprising the insect-specific promoter with a plurality of nucleic acids which together form the isolated nucleic acid of the second aspect.

Preferably, each of the plurality of nucleic acids that is joined according to the method of this aspect comprises nucleotide sequence overlap with respect to an adjacent nucleic acid.

In an eighth aspect, there is provided a vector produced according to the method of the seventh aspect. Preferably, the vector is of the sixth aspect.

In a ninth aspect, there is provided an isolated protein produced from the vector of the sixth or eighth aspects. Preferably, said protein is the protein of the first aspect.

In a tenth aspect there is provided an isolated chimeric insect-specific flavivirus produced from the vector of the sixth or eighth aspects. Preferably, said flavivirus is of the fifth aspect.

In an eleventh aspect, there is provided a method of producing an isolated chimeric insect-specific flavivirus comprising an isolated protein of the first aspect, the method including the steps of:

(a) combining a vector comprising (i) a nucleotide sequence capable of replicating a chimeric insect-specific flavivirus comprising the isolated protein of the first aspect; and (ii) an insect-specific promoter operably connected to (i), with an insect cell; and (b) allowing the chimeric insect-specific flavivirus replicable by (i) to replicate in the insect cell, to thereby produce the isolated chimeric insect-specific flavivirus comprising the isolated protein of the first aspect.

Preferably, the vector according to step (a) of this aspect, is the vector of the sixth or eighth aspects.

Preferably, combining the vector with the insect cell according to this aspect is in the form of transfection of the insect cell with the vector.

Preferably, the insect cell of this aspect is a mosquito cell or a fly cell. In preferred embodiments, the mosquito cell is an *Aedes* cell, preferably a C6/36 cell or C7/10 cell. In preferred embodiments, the fly cell is a *Drosophila* cell, preferably a S2 cell.

In preferred embodiments of the method of this aspect, the flavivirus is produced in the insect cell at a titre of at least: $10^4$/ml; $10^5$/ml; $10^6$/ml; $10^7$/ml; or $10^8$/ml. In one particularly preferred embodiment, the flavivirus is produced in the insect cell at a titre of greater than $10^7$/ml.

A twelfth aspect of the invention provides a method of modifying a chimeric insect-specific flavivirus, a protein of a chimeric insect-specific flavivirus, and/or a nucleic acid of a chimeric insect-specific flavivirus, including the step of replicating a chimeric insect-specific flavivirus in a cell, whereby one or more mutations are incorporated into the chimeric insect-specific flavivirus, a protein thereof, and/or nucleotide sequence thereof, to thereby modify the chimeric insect-specific flavivirus, protein thereof, and/or nucleic acid thereof.

Preferably, the step of replicating the chimeric insect-specific flavivirus according to the method of this aspect includes a plurality of replication cycles. Preferably, the chimeric insect-specific flavivirus is replicated in an insect cell, preferably a mosquito cell.

Preferably, the method of this aspect improves or enhances efficiency of replication of the chimeric insect specific flavivirus in one or more cells. Preferably, said one or more cells are insect cells, preferably mosquito cells. In a thirteenth aspect, there is provided an isolated chimeric insect-specific flavivirus, or a protein or nucleic acid thereof, produced according to the method of the eleventh or twelfth aspect. Preferably, said flavivirus is of the fifth or tenth aspect.

A fourteenth aspect of the invention provides a composition comprising the isolated protein of the first or ninth aspects, and/or the isolated flavivirus of the fifth, tenth or thirteenth aspects, and one or more carriers, diluents, or excipients.

In certain preferred embodiments of the thirteenth aspect, the composition is a pharmaceutical composition. Preferably, the pharmaceutical composition is a vaccine. In these embodiments, the one or more carriers, diluents, or excipients will be pharmaceutically acceptable carriers, diluents, or excipients.

In certain preferred embodiments of the fourteenth aspect, the composition is a diagnostic composition. The diagnostic composition may be for in vivo or in vitro use. Preferably, the diagnostic composition is for in vitro use. In an embodiment, the diagnostic composition may be, or may be a component of, a diagnostic kit.

A fifteenth aspect of the invention provides a method of eliciting an immune response in a subject, the method including the step of administering an effective amount of a pharmaceutical composition according to the fourteenth aspect to the subject, to thereby elicit an immune response in the subject.

A sixteenth aspect of the invention provides a method of immunizing a subject against a pathogen, the method including the step of administering an effective amount of the pharmaceutical composition of the fourteenth aspect to the subject, to thereby immunize the subject against the pathogen.

A seventeenth aspect of the invention provides a method of treating or preventing a disease, disorder, or condition in a subject, the method including the step of administering an effective amount of the pharmaceutical composition of the fourteenth aspect to the subject, to thereby treat or prevent the disease, disorder or condition in the subject.

Preferably, the subject of the fifteenth, sixteenth, and/or seventeenth aspects is an animal subject, preferably an invertebrate subject. In one preferred embodiment, said subject is a human subject. In other preferred embodiments, said subject is a reptile or avian subject.

Preferably, the disease, disorder, or condition according is associated with viral infection. Preferably, the disease, disorder, or condition is selected from the group consisting of Zika virus; West Nile virus; and Dengue virus.

An eighteenth aspect of the invention provides a method of detecting, identifying or screening for an antibody in a sample, the method including the steps of combining the diagnostic composition of the fourteenth aspect with a sample, wherein binding of an antibody in the sample to an immunogenic amino acid sequence of the isolated protein or isolated chimeric insect-specific flavivirus of the diagnostic composition facilitates detecting, identifying or screening for the antibody in the sample.

In a preferred embodiment, screening for the antibody according to the method of the seventeenth aspect is performed using an enzyme-linked immunosorbent assay (ELISA). The ELISA may be a direct ELISA or an indirect ELISA.

In a preferred embodiment, screening for the antibody according to the method of the seventeenth aspect is performed using a lateral flow immunoassay.

Preferably, the antibody according to the seventeenth aspect is, or has been, produced in response to a viral infection. Preferably, the viral infection is caused by or associated with a virus selected from the group consisting of: Zika virus; West Nile virus; and Dengue virus.

It will be appreciated that the indefinite articles "a" and "an" are not to be read as singular indefinite articles or as otherwise excluding more than one or more than a single subject to which the indefinite article refers. For example, "a" protein includes one protein, one or more proteins or a plurality of proteins.

As used herein, unless the context requires otherwise, the words "comprise", "comprises" and "comprising" will be understood to mean the inclusion of a stated integer or group of integers but not the exclusion of any other integer or group of integers.

BRIEF DESCRIPTION OF THE FIGURES

In order that the invention may be readily understood and put into practical effect, preferred embodiments will now be described by way of example with reference to the accompanying figures, wherein:

Figure 2:
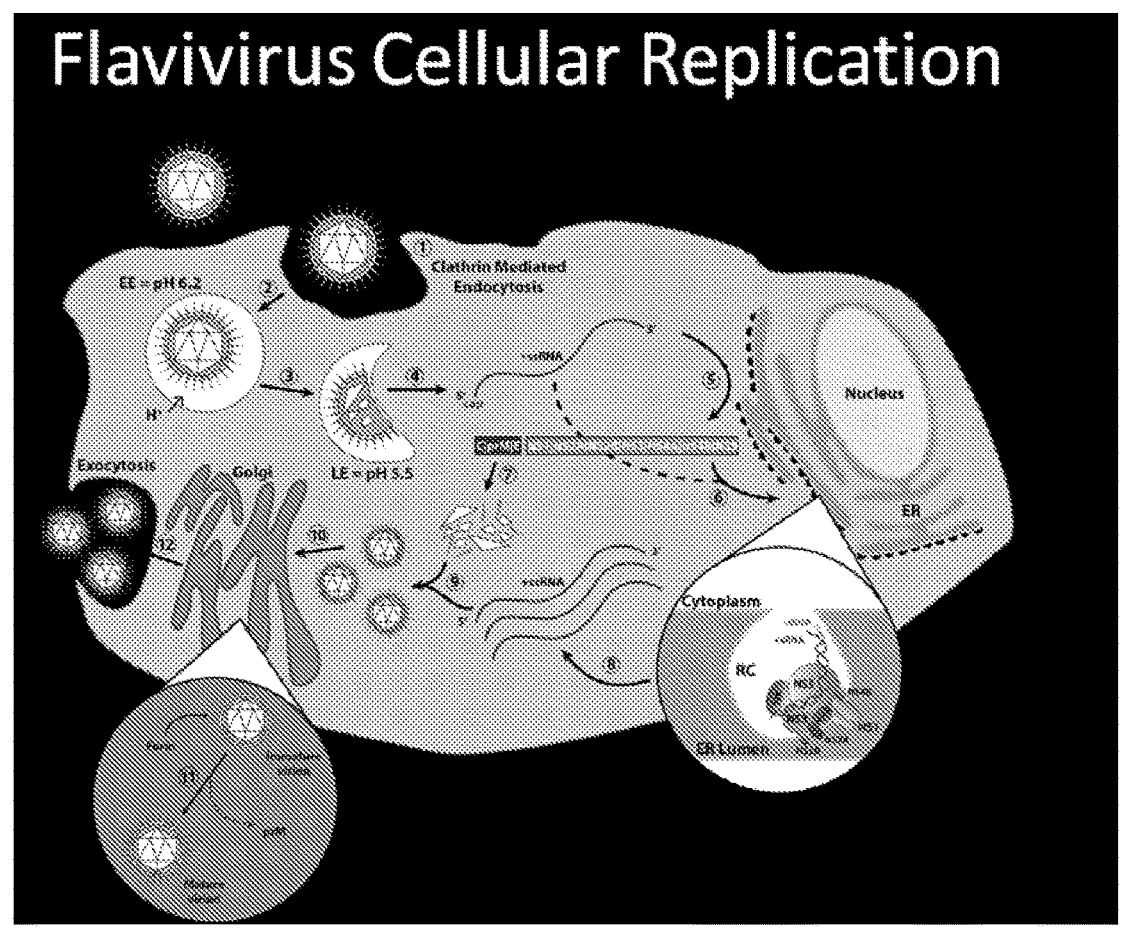

FIG. 2 provides a schematic of flavivirus replication.

FIG. 9 sets forth visualisation of WT and $IFNAR^{-/-}$ MEF cells infected with either $WNV_{KUN}$ or PaRV at an MOI of 0.1. Monolayers were fixed 72 hrs post-infection. IFA analysis was performed by probing with anti-PaRV (7D11), anti-$WNV_{KUN}$ (3.91D) and anti-dsRNA (3G1) mouse antibodies. The nucleus of each cell was stained with Hoechst 33342. Images were taken at ×40 magnification.

FIG. 12 sets forth SEQ ID NO:1 in FASTA format.

FIG. 13 sets forth SEQ ID NO:2 in FASTA format.

FIG. 14 sets forth SEQ ID NO:3 in FASTA format.

FIG. 15 sets forth SEQ ID NO:4 in FASTA format.

FIG. 16 sets forth SEQ ID NO:5 in FASTA format.

FIG. 17 sets forth SEQ ID NO:6 in FASTA format.

FIG. 18 sets forth SEQ ID NO:7 in FASTA format.

FIG. 19 sets forth SEQ ID NO:8 in FASTA format.

FIG. 20 sets forth SEQ ID NO:9 in FASTA format.
FIG. 21 sets forth SEQ ID NO:10 in FASTA format.
FIG. 22 sets forth SEQ ID NO:11 with nucleotide sequence numbering.
FIG. 23 sets forth SEQ ID NO:12 with nucleotide sequence numbering.
FIG. 24 sets forth SEQ ID NO:13 with nucleotide sequence numbering.
FIG. 25 sets forth SEQ ID NO:14 with nucleotide sequence numbering.
FIG. 26 sets forth SEQ ID NO:17 in FASTA format.
FIG. 27 sets forth SEQ ID NO:18 in FASTA format.
FIG. 28 sets forth SEQ ID NO:19 in FASTA format.
FIG. 29 sets forth SEQ ID NO:20 in FASTA format.
FIG. 30 sets forth SEQ ID NO:21 with nucleotide sequence numbering.
FIG. 31 sets forth SEQ ID NO:22 in FASTA format.
FIG. 32 sets forth SEQ ID NO:23 with nucleotide sequence numbering.
FIG. 33 sets forth SEQ ID NO:24 in FASTA format.
FIG. 34 sets forth SEQ ID NO:25 with nucleotide sequence numbering.
FIG. 35 sets forth SEQ ID NO:26 in FASTA format.
FIG. 36 sets forth SEQ ID NO:27 with nucleotide sequence numbering.
FIG. 37 sets forth SEQ ID NO:28 in FASTA format.
FIG. 38 sets forth SEQ ID NO:29 with nucleotide sequence numbering.
FIG. 39 sets forth SEQ ID NO:30 in FASTA format.
FIG. 40 sets forth SEQ ID NO:31 with nucleotide sequence numbering.
FIG. 41 sets forth SEQ ID NO:32 in FASTA format.
FIG. 42 sets forth SEQ ID NO:33 with nucleotide sequence numbering.
FIG. 43 sets forth SEQ ID NO:34 with nucleotide sequence numbering.
FIG. 44 sets forth SEQ ID NO:35 with nucleotide sequence numbering.
FIG. 45 sets forth SEQ ID NO:36 with nucleotide sequence numbering.
FIG. 46 sets forth SEQ ID NO:37 with nucleotide sequence numbering.
FIG. 47 sets forth SEQ ID NO:38 with nucleotide sequence numbering.
FIG. 48 sets forth SEQ ID NO:39 with nucleotide sequence numbering.
FIG. 49 sets forth SEQ ID NO:40 with nucleotide sequence numbering.
FIG. 50 sets forth SEQ ID NO:41 with nucleotide sequence numbering.
FIG. 51 sets forth SEQ ID NO:42 with nucleotide sequence numbering.
FIG. 52 sets forth SEQ ID NO:43 with nucleotide sequence numbering.
FIG. 53 sets forth SEQ ID NO:44 with nucleotide sequence numbering.
FIG. 54 sets forth SEQ ID NO:45 with nucleotide sequence numbering.
FIG. 55 sets forth SEQ ID NO:46 with nucleotide sequence numbering.
FIG. 56 sets forth SEQ ID NO:47 with nucleotide sequence numbering.
FIG. 57 sets forth SEQ ID NOS:382-383 in FASTA format.
FIG. 59 sets forth SEQ ID NO:384 in FASTA format.
FIG. 60 sets forth SEQ ID NO:385 with nucleotide sequence numbering.
FIG. 62 sets forth SEQ ID NO:386 in FASTA format.
FIG. 63 sets forth SEQ ID NO:387 in FASTA format.
FIG. 64 sets forth SEQ ID NO:388 in FASTA format.
FIG. 65 sets forth SEQ ID NO:389 in FASTA format.
FIG. 66 sets forth SEQ ID NO:390 in FASTA format.
FIG. 67 sets forth SEQ ID NO:391 in FASTA format.
FIG. 68 sets forth SEQ ID NO:392 in FASTA format.
FIG. 69 sets forth SEQ ID NO:393 in FASTA format.
FIG. 70 sets forth SEQ ID NO:394 in FASTA format.
FIG. 71 sets forth SEQ ID NO:395 in FASTA format.
FIG. 72 sets forth SEQ ID NO:396 in FASTA format.
FIG. 73 sets forth SEQ ID NO:397 in FASTA format.
FIG. 74 sets forth nucleotide (non-bold) and amino acid (bold) sequence similarity (percentage) between lineage II ISFs (dISFs) over ORF sequences. For BinJV and LiCV (labelled LLCFC), ORF sequences were as described herein. For the remaining lineage II ISFs, ORF sequence were obtained from the following Genbank references: EU159426 (NOUV), KC692068 (LAMV), JQ308185 (CHAOV), KC692067 (ILOV), KX359172 (PANFV), NC_016997 (DONV), JN603190 (MMV), JX627335 (NANV), KJ210048 (NHUV), KC496020 (BJV).
FIG. 75 sets forth nucleotide and amino acid sequence similarity (percentage) of lineage I ISFs (cISFs) over ORF sequences. Top-right half of the table is amino acid sequence similarity and bottom left half is nucleotide sequence similarity. PaRV: Parramatta River virus; CFAV: Cell fusing agent virus; CxFV: *Culex* flavivirus; QBV: Quang Binh virus; PCV: Palm Creek virus.
FIG. 76 sets forth a maximum likelihood analysis over ORF amino acid sequences for phylogenetic assessment of Lilly Creek virus (labelled LiLV) compared to BinJV as described herein and the sequences obtained from the following Genbank references (with virus name in brackets): AB488408 (AEFV); AY898809 (ALFV); KF917535 (AROAV); KM225264 (Bainyik virus); DQ859056 (BANV); KU308380 (BgV); (LLCFV); KC496020 (BJV); KJ741267 (CFAV); JQ308185 (CHAOV); HE574574 (CTFV); U88536 (DENY-1); U87411 (DENY-2); AY099336 (DENY-3); AF326825 (DENY-4); DQ859060 (EHV); DQ837641 (ENTV); DQ235145 (GGYV); NC_030401 (HANKY); KC692067 (ILOV); M18370 (JEV); DQ859066 (JUGV); AY632541 (KOKV); AY149905 (KRV); KC692068 (LAMV); KC692067 (LIV); AJ242984 (MODV); AF161266 (MVEV); NC_030400 (NAKV); KJ210048 (NHUV); JQ957875 (NIEV); KC788512 (NMV); EU159426 (NOUV); AY193805 (OHFV); KT192549 (PaRV); KC505248 (PCV); DQ859067 (POTV); L06436 (POWV); FJ644291 (QBV); NC_003675 (RBV); DQ859062 (SABV); DQ837642 (SEPV); DQ525916 (SLEV); DQ859064 (SPOV); DQ235150 (SREV); KM225263 (STRV); U27495 (TBEV); KM225265 (Torres virus); DQ859065 (UGSV); JN226796 (WESSV); KY229074 (WNV); X03700 (YFV); AB114858 (YOKV); AY632535 (ZIKV).
FIG. 77 sets forth analysis of LiCV growth in mosquito (C6/36, mos55) and vertebrate (BSR, Vero) cell lines. West Nile virus ($WNV_{KUN}$) is also included as a control.

FIG. 78 sets forth amino acid similarity of BinJV and LiCV envelope proteins in comparison to vertebrate-infecting flavivirus envelope proteins.

FIG. 79 sets forth a comparison of the growth of BinJV and associated chimeras to that of PCV and an associated chimera.

FIG. 80 sets forth an assessment of BinJV host restriction. (A) Immunofluorescence images of BinJV, $WNV_{KUN}$, and Mock inoculated insect cells lines (S2, mos55, HSU, Chao Ball, RML-12, and C636). (B) Immunofluorescence images of BinJV (bottom), $WNV_{KUN}$ (middle), and Mock (top) inoculated vertebrate cell lines (BSR, DF-1, Vero, OK, SW-13, MEF wild type, and MEF IFNAR$^{+}$). A tabulated summary of replication results in (A) and (B) is provided at the top of the figure.

Figure 82:
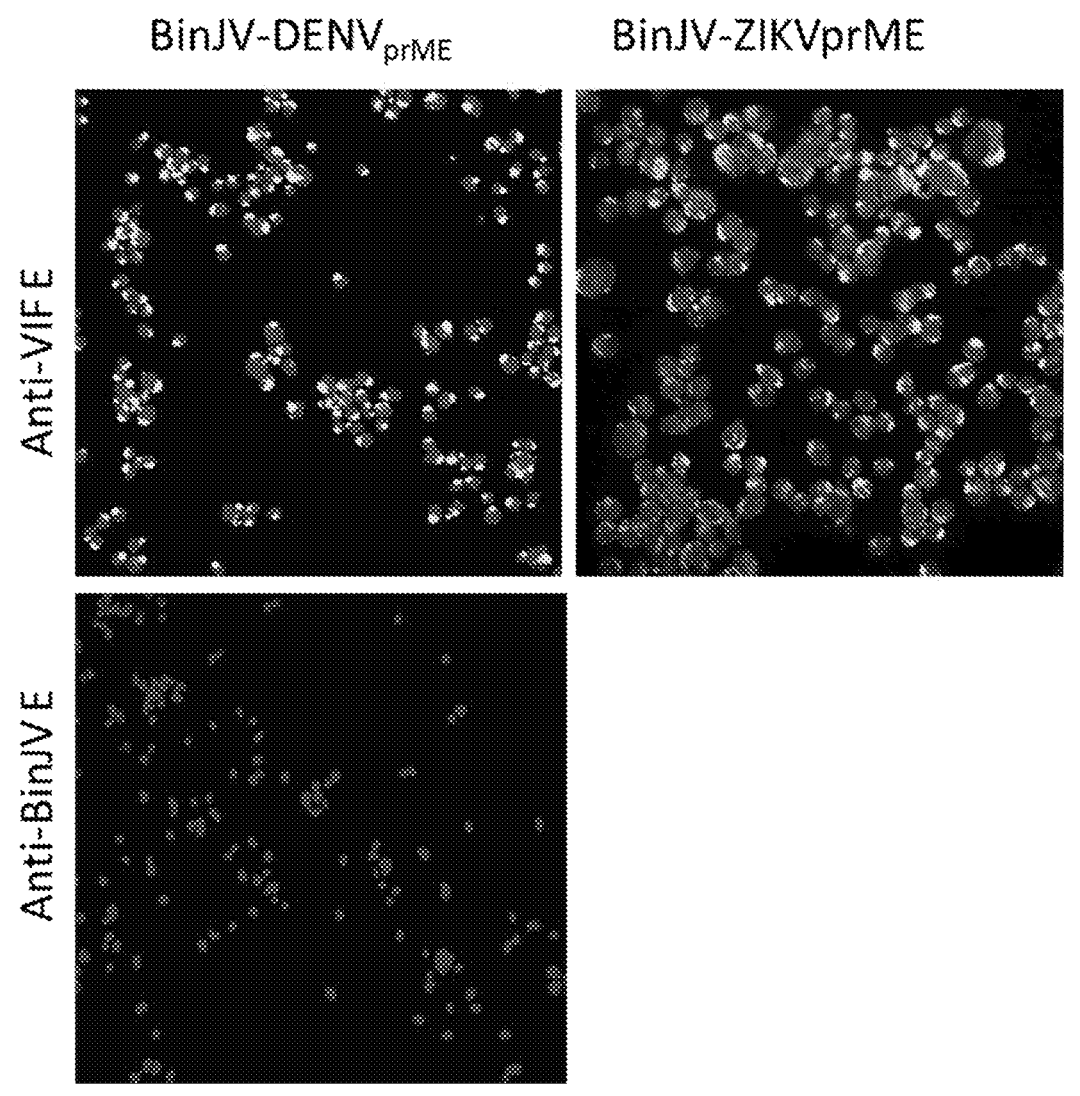

FIG. 82 sets forth an assessment of replication of BinJV/DENV1-prME (labelled BinJV-$DENV_{prME}$) and BinJV/ZIKV-prME (labelled BinJV-ZIKVprME) in mosquito cells. Top: results of staining (green) of mosquito cells inoculated with chimeric ISFs using an anti-DENY or anti-ZIKV E protein antibody (top); and an anti-BinJV E protein (bottom).

FIG. 83 sets forth an assessment of mutation of EDII fusion loop in BinJV and LiCV. (A) An alignment of E domain II residues (blue box) in BinJV, LiCV and other flaviviruses. Conserved residues are highlighted. Fusion loop is indicated by red box. BinJV (SEQ ID NO: 406) and LiCV (SEQ ID NO: 407) sequences used were as described herein. Sequence for the other flaviviruses was obtained from the following Genbank references: KC692068 (LAMV) (SEQ ID NO: 412); JQ308185 (CHAOV) (SEQ ID NO: 411); KC692067 (ILOV) (SEQ ID NO: 410); EU159426 (NOUV) (SEQ ID NO: 408); KJ210048 (NHUV) (SEQ ID NO: 409); KC496020 (BJV) (SEQ ID NO: 413); U88536 (DENV-1) (SEQ ID NO: 416); AY632535 (ZIKV) (SEQ ID NO: 417); M18370 (JEV) (SEQ ID NO: 414); KY229074 (WNV) (SEQ ID NO: 415). (B) Immunofluorescence analysis of 4G2 detection of wild-type BinJV ($BinJV_{WT}$ V106) and BinJV with key mutated residue ($BinJV_{V106G}$).

FIG. 84 sets forth immunofluorescent confirmation of the successful production of a BinJV/WNVEDI (labelled BinJV-$WNV_{EDI}$) chimera wherein a 19 amino acid peptide from the WNV E protein was inserted into the homologous region of DI of BinJV. For comparison BinJV/$WNV_{KUN}$-prME (labelled BinJV-$WNV_{STR}$) is included. Interpretation of the staining is indicated in the bottom right-hand corner of each image.

FIG. 86 sets forth growth kinetics of chimeric ISF vectors before and after serial passaging in C6/36 mosquito cells. (A) Replication in C6/36 cells of: PCV/$WNV_{KUN}$-prME not exposed to serial passaging (P1); PCV/$WNV_{KUN}$-prME serially passaged 10 times (P10); and wild type PCV. (B) Replication in mosquito cells of PCV/ZIKV-prME not exposed to serial passaging (P1); PCV/ZIKV-prME serially passaged 10 times (P10); and wild type PCV.

FIG. 87 sets forth an assessment of the use of PCV/$WNV_{KUN}$-prME in ELISA to detect WNV-specific antibodies in human, horse, and crocodile sera.

FIG. 89 sets forth neutralisation of PCV/$WNV_{KUN}$-prME (labelled PCV-$WNV_{STR}$), BinJV/$WNV_{KUN}$-prME (labelled BinJV-$WNV_{STR}$), and wild type WNV replication using dilutions of virus positive and naïve (A) human; (B) horse; (C) crocodile; and (D) rabbit sera.

Figure 91:
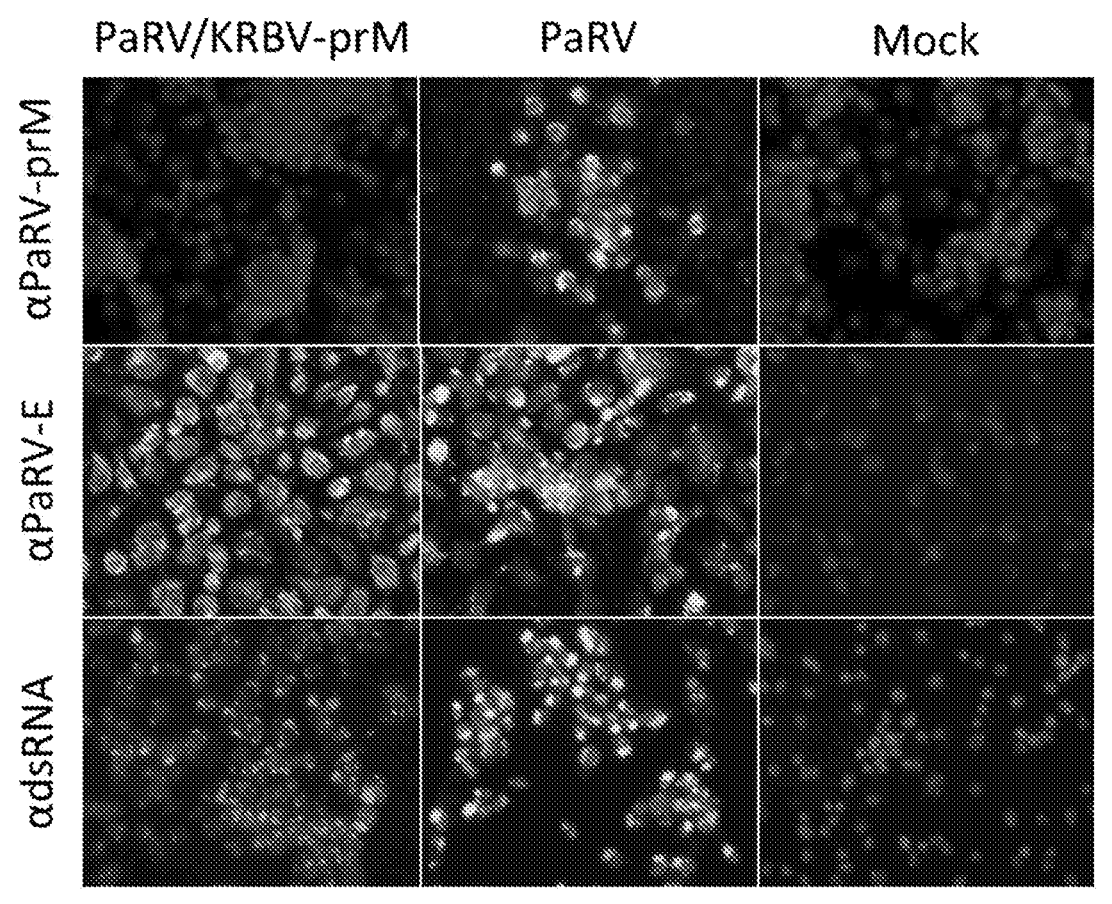

FIG. 91 sets forth IFA staining of C6/36 mosquito cells infected with PaRV/KRBV-prM and wild type PaRV. Positive staining of anti-PaRV E mAb occurs to chimeric and wild type infected cells. In contrast, a mAb specific to PaRV-prM only detected wild type-PaRV and not the PaRV/KRBV-prM chimera.

Figure 92:
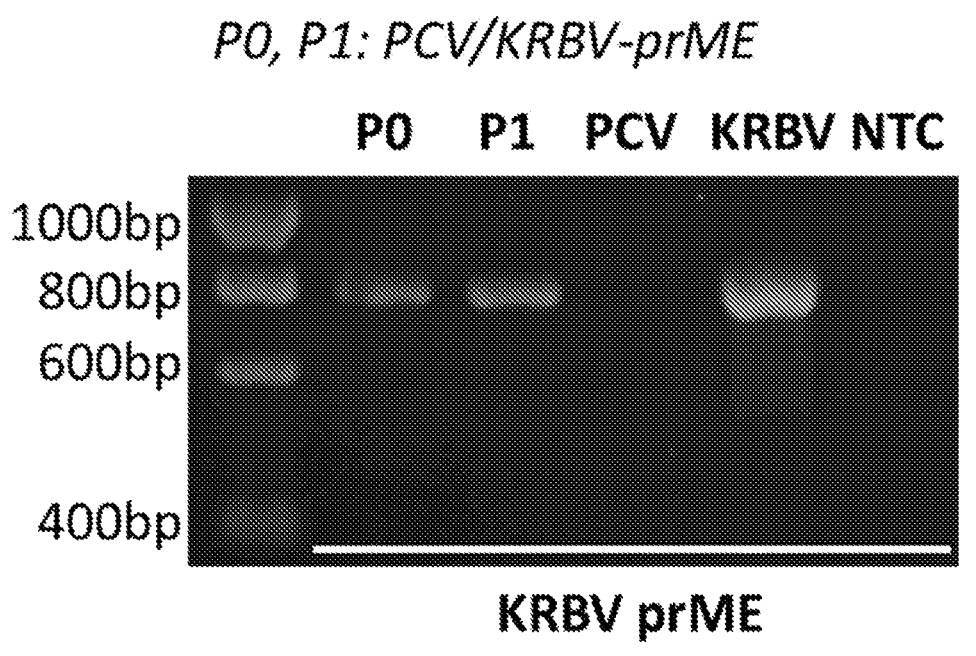

FIG. 92 sets forth confirmation at P0 and P1 by RT-PCR of RNA extracted from PCV/KRBV-prME-infected cells. The RT-PCR was performed with KRBV E protein-specific primers (band at 800 bp). Extracted RNA from PCV and KRBV served as negative and positive controls, respectively, while a no template control (NTC) served as an additional negative control.

FIG. 94 sets forth SEQ ID NO:398 in FASTA format.

FIG. 95 sets forth SEQ ID NO:399 in FASTA format.

FIG. 96 sets forth SEQ ID NO:400 with nucleotide sequence numbering.

FIG. 97 sets forth SEQ ID NO:401 with nucleotide sequence numbering.

FIG. 98 sets forth SEQ ID NO:402 with amino acid sequence numbering.

FIG. 99 sets forth SEQ ID NO:403 with amino acid sequence numbering.

FIG. 100 sets forth SEQ ID NO:404 with amino acid sequence numbering.

FIG. 101 sets forth SEQ ID NO:405 with amino acid sequence numbering.

BRIEF DESCRIPTION OF THE SEQUENCE LISTING

Figure 1:
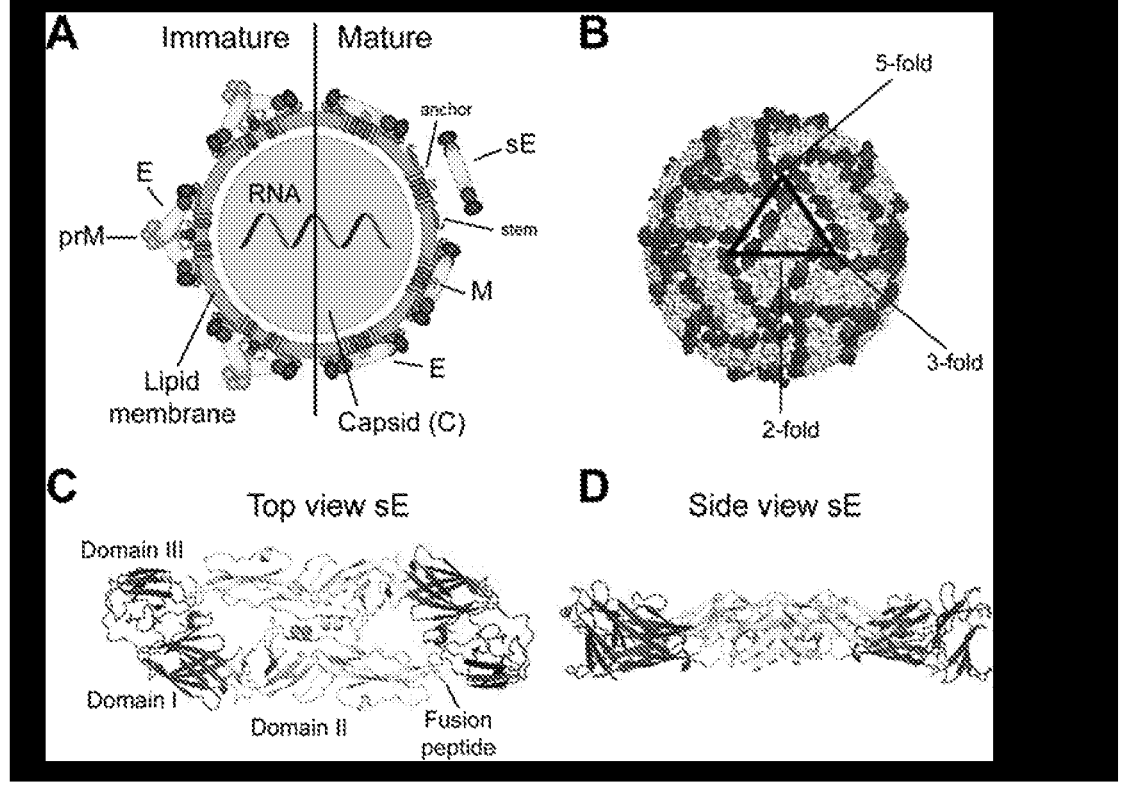
FIG. 1 illustrates general flavivirus virion structure.

SEQ ID NO:1 Amino acid sequence of a PCV/$WNV_{KUN}$-prME chimeric ISF protein comprising C and NS1-NS5 proteins from PCV and prM and E proteins from West Nile virus Kunjin subtype ($WNV_{KUNV}$).

SEQ ID NO:2 Amino acid sequence of a PCV/ZIKA-prME chimeric ISF protein comprising C and NS1-NS5 proteins from PCV and prM and E proteins from ZIKA.

SEQ ID NO:3 Amino acid sequence of a PCV/DENV2-prME chimeric ISF protein comprising C and NS1-NS5 proteins from PCV and prM and E proteins from DENV2.

SEQ ID NO:4 Amino acid sequence of a BgV/WNV$_{KUN}$-prME chimeric ISF protein comprising C and NS1-NS5 proteins from BgV and prM and E proteins from WNV$_{KUNV}$.

SEQ ID NO:5 Amino acid sequence of a PCV polyprotein.

SEQ ID NO:6 Amino acid sequence of a BinJV polyprotein.

SEQ ID NO:7 Amino acid sequence of a BgV polyprotein.

SEQ ID NO:8 Amino acid sequence of a WNV$_{KUN}$ polyprotein.

SEQ ID NO:9 Amino acid sequence of a ZIKA polyprotein.

SEQ ID NO:10 Amino acid sequence of a DENV2 polyprotein.

SEQ ID NO:11 Nucleotide sequence of a PCV/WNV$_{KUN}$-prME chimeric ISF vector.

SEQ ID NO:12 Nucleotide sequence of a PCV/ZIKA-prME chimeric ISF vector.

SEQ ID NO:13 Nucleotide sequence of a PCV/DENV2-prME chimeric ISF vector.

SEQ ID NO:14 Nucleotide sequence of a BgV/WNV$_{KUNV}$-prME chimeric ISF vector.

SEQ ID NO:15 Nucleotide sequence of an OpIE2 promoter.

SEQ ID NO:16 Nucleotide sequence of an OpIE2-CA promoter.

SEQ ID NO:17 Amino acid sequence of a KRBV polyprotein.

SEQ ID NO:18 Amino acid sequence of a Parramatta River virus polyprotein.

SEQ ID NO:19 Amino acid sequence of a CFAV polyprotein.

SEQ ID NO:20 Amino acid sequence of a WNV$_{KUN}$/PCV-prME chimeric ISF protein comprising C and NS1-NS5 proteins from WNV$_{KUN}$ and prM and E proteins from PCV.

SEQ ID NO:21 Nucleotide sequence of a WNV$_{KUN}$/PCV-prME chimeric ISF vector.

SEQ ID NO:22 Amino acid sequence of a WNV$_{KUN}$/BgV-prME chimeric ISF protein comprising C and NS1-NS5 proteins from WNV$_{KUN}$ and prM and E proteins from BgV.

SEQ ID NO:23 Nucleotide sequence of a WNV$_{KUN}$/BgV-prME chimeric ISF vector.

SEQ ID NO:24 Amino acid sequence of a WNV$_{KUN}$/BinJV-prME chimeric ISF protein comprising C and NS1-NS5 proteins from WNV$_{KUN}$ and prM and E proteins from BinJV.

SEQ ID NO:25 Nucleotide sequence of a WNV$_{KUN}$/BinJV-prME chimeric ISF vector.

SEQ ID NO:26 Amino acid sequence of WNV$_{KUN}$/CFAV-prME chimeric ISF protein comprising C and NS1-NS5 proteins from WNV$_{KUN}$ and prM and E proteins from BinJV.

SEQ ID NO:27 Nucleotide sequence of WNV$_{KUN}$/CFAV-prME chimeric ISF vector.

SEQ ID NO:28 Amino acid sequence of WNV$_{KUN}$/KRBV-prME chimeric ISF protein comprising C and NS1-NS5 proteins from WNV$_{KUN}$ and prM and E proteins from KRBV.

SEQ ID NO:29 Nucleotide sequence of WNV$_{KUN}$/KRBV-prME chimeric ISF vector.

SEQ ID NO:30 Amino acid sequence of WNV$_{KUN}$/PaRV-prME chimeric ISF protein comprising C and NS1-NS5 proteins from WNV$_{KUN}$ and prM and E proteins from PaRV.

SEQ ID NO:31 Nucleotide sequence of WNV$_{KUN}$/PaRV-prME chimeric ISF vector.

SEQ ID NO:32 Amino acid sequence of BinJV/WNV$_{KUNV}$-EDIII chimeric ISF protein.

SEQ ID NO:33 Nucleotide sequence of BinJV/WNV$_{KUNV}$-EDIII chimeric ISF protein.

SEQ ID NO:34 Nucleotide sequence of CPEC vector encoding BgV polyprotein driven by OpIE2-CA.

SEQ ID NO:35 Nucleotide sequence of CPEC vector encoding BinJV polyprotein driven by OpIE2-CA.

SEQ ID NO:36 Nucleotide sequence of CPEC vector encoding PCV polyprotein driven by OpIE2-CA.

SEQ ID NO:37 Nucleotide sequence of CPEC vector encoding PaRV polyprotein driven by OpIE2-CA.

SEQ ID NO:38 Nucleotide sequence of CPEC vector encoding WNV$_{KUNV}$ polyprotein driven by OpIE2-CA.

SEQ ID NO:39 PCV genomic nucleotide sequence.

SEQ ID NO:40 BinJV genomic nucleotide sequence.

SEQ ID NO:41 BgV genomic nucleotide sequence.

SEQ ID NO:42 KRBV genomic nucleotide sequence.

SEQ ID NO:43 PaRV genomic nucleotide sequence.

SEQ ID NO:44 CFAV genomic nucleotide sequence.

SEQ ID NO:45 WNV$_{KUN}$ genomic nucleotide sequence

SEQ ID NO:46 ZIKA genomic nucleotide sequence.

SEQ ID NO:47 DENV2 genomic nucleotide sequence.

SEQ ID NOS:48-79 CPEC primers for producing BgV/WNV$_{KUN}$-prME vector.

SEQ ID NOS:80-96 CPEC primers for producing BinJV/WNV$_{KUN}$-EDIII vector.

SEQ ID NOS:97-138 CPEC primers for producing WNV$_{KUN}$/BgV-prME vector.

SEQ ID NOS:139-173 CPEC primers for producing WNV$_{KUN}$/BinJV-prME vector.

SEQ ID NOS:174-208 CPEC primers for producing WNV$_{KUN}$/CFAV-prME vector.

SEQ ID NOS:209-241 CPEC primers for producing WNV$_{KUN}$/KRBV-prME vector.

SEQ ID NOS:242-282 CPEC primers for producing WNV$_{KUN}$/PaRV-prME vector.

SEQ ID NOS:283-317 CPEC primers for producing WNV$_{KUN}$/PCV-prME vector.

SEQ ID NOS:318-338 CPEC primers for producing PCV/DENV2-prME vector.

SEQ ID NOS:339-360 CPEC primers for producing PCV/WNV$_{KUN}$-prME vector.

SEQ ID NOS:361-381 CPEC primers for producing PCV/ZIKV-prME vector.

SEQ ID NO:382 P10 promoter sequence of AcMNP.

SEQ ID NO:383 Polyhedrin promoter sequence of AcMNP.

SEQ ID NO:384 Amino acid sequence of PaRV/WNV$_{KUN}$-prME chimeric ISF protein comprising C and NS1-NS5 proteins from PaRV and prM and E proteins from WNV$_{KUN}$.

SEQ ID NO:385 Nucleotide sequence of PaRV/WNV$_{KUN}$-prME chimeric ISF vector.

SEQ ID NO:386 Genomic nucleotide sequence of Lilly Creek virus (LiCV).

SEQ ID NO:387 Amino acid sequence of ORF of Lilly Creek virus.

SEQ ID NO:388 Nucleotide sequence of BinJV-WNV$_{KUNV}$-prME chimeric ISF vector.

SEQ ID NO:389 Amino acid sequence of BinJV/WNV$_{KUNV}$-prME ORF.

SEQ ID NO:390 Nucleotide sequence of BinJV/ZIKV-prME chimeric ISF vector.

SEQ ID NO:391 Amino acid sequence of BinJV/ZIKV-prME ORF.

SEQ ID NO:392 Nucleotide sequence of BinJV/WNVED1 chimeric ISF vector.

SEQ ID NO:393 Amino acid sequence of BinJV/WNVED1 ORF.

SEQ ID NO:394 Nucleotide sequence of BinJV/DENV1-prME chimeric ISF vector.

SEQ ID NO:395 Amino acid sequence of BinJV/DENV1-prME ORF.

SEQ ID NO:396 Nucleotide sequence of $BinJV_{V106G}$ vector.

SEQ ID NO:397 Amino acid sequence of $BinJV_{V106G}$ ORF.

SEQ ID NO:398 Nucleotide sequence of PaRV/KRBV-prM chimeric ISF vector.

SEQ ID NO:399 Nucleotide sequence of PCV/KRBV-prME chimeric ISF vector.

SEQ ID NO:400 Nucleotide sequence of PCV/ZIKV-prME P1 chimeric ISF vector.

SEQ ID NO:401 Nucleotide sequence of PCV/ZIKV-prME P10 chimeric ISF vector.

SEQ ID NO:402 Amino acid sequence of PaRV/KRBV-prM ORF.

SEQ ID NO:403 Amino acid sequence of PCV/ZIKV-prME P1 ORF.

SEQ ID NO:404 Amino acid sequence of PCV/ZIKV-prME P10 ORF.

SEQ ID NO:405 Amino acid sequence of PaRV/KRBV-prME ORF.

DETAILED DESCRIPTION

The present invention is partly predicated on the realization that chimeric insect-specific flaviviruses, and proteins and/or particles thereof, offer potential for new vaccines. The invention is also partly predicated on the realization that chimeric insect-specific flaviviruses, and proteins and/or particles thereof, offer potential for new diagnostics.

In particular, the inventors have realised that chimeric insect-specific flaviviruses (and corresponding proteins and/or particles) containing immunogenic sequence can potentially be used directly for vaccination of vertebrate subjects (e.g. humans; avians; reptiles), as these insect-specific flaviviruses are not expected to substantially replicate in or infect non-insect cells. The inventors have further realised that chimeric insect-specific flaviviruses (and corresponding proteins and/or particles) may be useful in assays for the detection of antibodies, and may have advantages (for example in relation to safety; efficacy; and/or specificity) in this context.

The invention is also partly predicated on the discovery of design elements important for the construction of vectors to allow for the production of chimeric insect-specific flaviviruses, and proteins and/or particles thereof, from insect cells.

Isolated Proteins

Accordingly, one aspect of the invention provides an isolated protein comprising:

(i) an amino acid sequence of a protein encoded by the genome of an insect-specific flavivirus; and (ii) an immunogenic amino acid sequence not encoded by the genome of an insect-specific flavivirus.

For the purposes of this invention, by "isolated" is meant material (e.g. proteins, nucleic acids, cells etc.) that has been removed from its natural state or otherwise been subjected to human manipulation. Isolated material may be substantially or essentially free from components that normally accompany it in its natural state, or may be manipulated so as to be in an artificial state together with components that normally accompany it in its natural state. Isolated material may be in native, chemical synthetic or recombinant form.

As used herein, "flavirus", "flaviruses", "flaviviral" etc. refers to members of the genus *Flavivirus* within the family Flaviviridae. As will be readily understood by the skilled person flaviviruses are enveloped viruses, with icosahedral or spherical geometries, and a typical diameter of around 50 nm. Flaviviruses comprise structural and non-structural proteins. Specifically, flavivirus proteins typically comprise three structural proteins (Capsid, prM, and Envelope) and seven non-structural proteins (NS1, NS2A, NS2B, NS3, NS4A, NS4B, NS5).

It will be understood that the term protein "protein" is used herein to mean an amino acid polymer, comprising natural and/or non-natural amino acids, including L- and D-isomeric forms as are well understood in the art. Additionally, for the purposes of this invention, it will be understood that the term "protein" includes and encompasses both individual protein subunits, and complexes of individual protein subunits. As will be readily appreciated by the skilled person, flavivirus proteins typically originate as a single 'polyprotein', which is subsequently processed into the individual structural and non-structural proteins of the flavivirus during replication. It will be understood that an isolated protein of this aspect includes such polyproteins, as well as complexes of any or all individual structural and/or non-structural flavivirus protein subunits, as described above.

It will be further appreciated that, in addition to structural and non-structural proteins, flaviviruses comprise a nucleic acid genome encoding these proteins. Specifically, flavivirus genomes are linear positive-sense RNA and non-segmented, and generally about 10-11 kb in length. The genomic RNA is typically modified at the 5' end with a cap-1 structure.

In the context of this invention, an "insect-specific flavivirus" (or "ISF") will be understood to be a flavivirus which infects a suitable insect host and/or grows and replicates in suitable insect cell lines, but which does not grow or replicate, or at least demonstrates substantially restricted growth or replication, in at least wild type vertebrate cell lines. For an overview of ISFs, the skilled person is directed to Calzolari et al. (2016) *Infections, Genetics and Evolution*, 40: 381-388, and Blitvich and Firth (2015) Viruses, 7: 1927-1959; incorporated herein by reference.

For the purposes of this invention, ISFs will be understood to include known wild type ISFs, such as those described in Calzolari et al.; and Blitvich and Firth, supra, as well as flavivirus mutants, variants, recombinants, and derivatives etc. which similarly infect a suitable insect host and/or grow and replicate in suitable insect cell lines, but which do not grow or replicate, or at least demonstrate substantially restricted growth or replication, in at least wild type vertebrate cell lines. With reference to Colmant et al. (2016) *Journal of General Virology*, 97: 1087-1093, it will be appreciated that Bamaga virus (BgV) infects a mosquito host, and also demonstrates some restricted replication in certain wild type vertebrate cell lines. For the purposes of this invention, BgV, and similar viruses which infect an insect or mosquito host but also demonstrate some restricted replication in wild type vertebrate cell lines, will be considered an "ISF-like" virus.

Typically, for the purpose of this invention, an ISF-like virus will be considered to fall within the scope of an insect-specific flavivirus. However, in certain embodiments, the insect-specific flavivirus excludes ISF-like viruses, such as BgV.

The terms "immunogenic amino acid sequence", "immunogenic sequence", "immunogenic protein, etc. are used interchangeably herein with immunogen, antigen, epitope, antigenic sequence, polytope, immunogenic peptide, peptide, antigenic epitope etc. as is known in the art to denote or refer to a sequence capable of eliciting an immune response, and more particularly a specific or desired immune response such as protective immune response or memory immune response. The term immunogen broadly includes any type of molecule which is recognized by a host immune system as being foreign Immunogenic sequences of the invention may comprise B and/or T-cell epitopes.

In certain particularly preferred embodiments, the isolated protein of this aspect is or comprises an amino acid sequence set forth in SEQ ID NOS:1-4 or SEQ ID NOS:32, 389, 391, or 395, or a fragment, variant, or derivative thereof. In certain embodiments, the isolated protein of this aspect is or comprises an amino acid sequence set forth in SEQ ID NOS:20, 22, 24, 26, 28, 30, 384, 393, 397, or 402-405, or a fragment or variant thereof.

In certain embodiments, a "fragment" protein of this aspect comprises an amino acid sequence which constitutes less than 100%, but at least 20%, preferably at least 30%, more preferably at least 80% or even more preferably at least 90%, 95%, 96%, 97%, 98% or 99% of an amino acid sequence set forth in SEQ ID NOS:1-4 or SEQ ID NOS:32, 389, 391, or 395; or SEQ ID NOS:20, 22, 24, 26, 28, 30, 384, 393, 397, or 402-405. In one preferred embodiment the protein fragment comprises no more than 100, 200, 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, or 3400 contiguous amino acid sequences of an amino acid sequence set forth in SEQ ID NOS:1-4 or SEQ ID NOS:32, 389, 391, or 395; or SEQ ID NOS:20, 22, 24, 26, 28, 30, 384, or 397.

As used herein a "variant" protein or nucleic acid, respectively, will be understood to be one in which one or more amino acids or nucleotides, respectively have been deleted or substituted by different amino acids or nucleotides, respectively. Variants include naturally occurring (e.g., allelic) variants, orthologs (e.g. from other species) and synthetic variants, such as produced in vitro using mutagenesis techniques.

In some embodiments of this aspect, the isolated protein fragment includes an amino acid sequences having at least 75%, 80%, 85%, 90% or 95%, 96%, 97%, 98% or 99% amino acid sequence identity with a nucleotide sequence set forth in SEQ ID NOS:1-4, 32, 389, 391, or 395; or SEQ ID NOS:20, 22, 24, 26, 28, 30, 384, or 397.

Terms used generally herein to describe sequence relationships between respective amino acid and nucleotide sequences and sequences include "comparison window", "sequence identity", "percentage of sequence identity" and "substantial identity". Because respective nucleic acids/proteins may each comprise (1) only one or more portions of a complete nucleic acid/protein sequence that are shared by the nucleic acids/proteins, and (2) one or more portions which are divergent between the nucleic acids/proteins, sequence comparisons are typically performed by comparing sequences over a "comparison window" to identify and compare local regions of sequence similarity. A "comparison window" refers to a conceptual segment of typically 6, 9 or 12 contiguous residues that is compared to a reference sequence.

The comparison window may comprise additions or deletions (i.e., gaps) of about 20% or less as compared to the reference sequence for optimal alignment of the respective sequences. Optimal alignment of sequences for aligning a comparison window may be conducted by computerised implementations of algorithms (Geneworks program by Intelligenetics; GAP, BESTFIT, FASTA, and TFASTA in the Wisconsin Genetics Software Package Release 7.0, Genetics Computer Group, 575 Science Drive Madison, Wis., USA, incorporated herein by reference) or by inspection and the best alignment (i.e., resulting in the highest percentage homology over the comparison window) generated by any of the various methods selected. Reference also may be made to the BLAST family of programs as for example disclosed by Altschul et al., 1997, Nucl. Acids Res. 25 3389, which is incorporated herein by reference. A detailed discussion of sequence analysis can be found in Unit 19.3 of CURRENT PROTOCOLS IN MOLECULAR BIOLOGY Eds. Ausubel et al. (John Wiley & Sons Inc NY, 1995-1999).

The term "sequence identity" is used herein in its broadest sense to include the number of exact nucleotide or amino acid matches having regard to an appropriate alignment using a standard algorithm, having regard to the extent that sequences are identical over a window of comparison. Thus, a "percentage of sequence identity" is calculated by comparing two optimally aligned sequences over the window of comparison, determining the number of positions at which the identical nucleic acid base (e.g., A, T, C, G, U) or amino acid occurs in both sequences to yield the number of matched positions, dividing the number of matched positions by the total number of positions in the window of comparison (i.e., the window size), and multiplying the result by 100 to yield the percentage of sequence identity. For example, "sequence identity" may be understood to mean the "match percentage" calculated by the DNASIS computer program (Version 2.5 for Windows; available from Hitachi Software engineering Co., Ltd., South San Francisco, Calif., USA).

A detailed discussion of sequence analysis can be found in Chapter 19.3 of Ausubel et al., supra.

It will be appreciated that, without limitation, protein and nucleic acid variants can be created by mutagenizing a protein or an encoding nucleic acid, such as by random mutagenesis or site-directed mutagenesis. Examples of nucleic acid mutagenesis methods are provided in Chapter 9 of CURRENT PROTOCOLS IN MOLECULAR BIOLOGY, Ausubel et al., supra which is incorporated herein by reference. Mutagenesis may also be induced by chemical means, such as ethyl methane sulphonate (EMS) and/or irradiation means, such as fast neutron irradiation of seeds as known in the art (Carroll et al., 1985, Proc. Natl. Acad. Sci. USA 82 4162; Carroll et al, 1985, Plant Physiol. 78 34; Men et al., 2002, Genome Letters 3 147).

Also included according to this aspect are derivative amino acid sequences and/or proteins.

As used herein, "derivative" proteins are proteins that have been altered, for example by conjugation or complexing with other chemical moieties or by post-translational modification techniques as would be understood in the art. Such derivatives include amino acid deletions and/or additions to polypeptides of the invention, or variants thereof.

"Additions" of amino acids may include fusion of the peptide or polypeptides of the invention, or variants thereof, with other peptides or polypeptides. Particular examples of such peptides include amino (N) and carboxyl (C) terminal amino acids added for use as fusion partners or tags.

Well-known examples of fusion partners include hexa-histidine (6X-HIS)-tag, N-Flag, Fc portion of human IgG, glutathione-S-transferase (GST) and maltose binding protein (MBP), which are particularly useful for isolation of the fusion polypeptide by affinity chromatography. For the purposes of fusion polypeptide purification by affinity chromatography, relevant matrices for affinity chromatography may include nickel-conjugated or cobalt-conjugated resins, fusion polypeptide specific antibodies, glutathione-conjugated resins, and amylose-conjugated resins respectively. Some matrices are available in "kit" form, such as the ProBond™ Purification System (Invitrogene Corp.) which incorporates a 6X-His fusion vector and purification using ProBond™ resin.

The fusion partners may also have protease cleavage sites, for example enterokinase (available from Invitrogen Corp. as EnterokinaseMax™), Factor $X_a$ or Thrombin, which allow the relevant protease to digest the fusion polypeptide of the invention and thereby liberate the recombinant polypeptide of the invention therefrom. The liberated polypeptide can then be isolated from the fusion partner by subsequent chromatographic separation.

Fusion partners may also include within their scope "epitope tags", which are usually short peptide sequences for which a specific antibody is available.

Other derivatives contemplated by the invention include, chemical modification to side chains, incorporation of unnatural amino acids and/or their derivatives during peptide or polypeptide synthesis and the use of cross linkers and other methods which impose conformational constraints on the polypeptides, fragments and variants of the invention.

Non-limiting examples of side chain modifications contemplated by the present invention include chemical modifications of amino groups, carboxyl groups, guanidine groups of arginine residues, sulphydryl groups, tryptophan residues, tyrosine residues and/or the imidazole ring of histidine residues, as are well understood in the art.

Non-limiting examples of incorporating unnatural amino acids and derivatives during peptide synthesis include, use of 4-amino butyric acid, 6-aminohexanoic acid, 4-amino-3-hydroxy-5-phenylpentanoic acid, 4-amino-3-hydroxy-6-methylheptanoic acid, t-butylglycine, norleucine, norvaline, phenylglycine, ornithine, sarcosine, 2-thienyl alanine and/or D-isomers of amino acids.

In some preferred embodiments, the isolated protein of this aspect will be of an isolated chimeric insect-specific flavivirus, as hereinbelow described.

Suitably, the isolated protein is, or is of, a virus particle. As used herein, a "virus particle" will be understood to encompass infectious complete virus particles, and subviral particles, as are well known in the art. In particular regard to subviral particles, as will be readily understood by the skilled person, these particles contain viral proteins but typically do not contain viral genetic material. As such, subviral particles are typically incapable of self-replication. Subviral particles will generally contain structural flavivirus proteins and may contain non-structural flavivirus proteins. One particular, non-limiting example of a subviral particle is a VLP.

As is known in the art, subviral particles (inclusive of VLPs) may be produced by expression, e.g. in vitro expression, of viral proteins followed by assembly of these proteins. For an overview of subviral particle (e.g. VLP) production, the skilled person is directed to Machida and Imataka (2015) Biotechnology Letters 37(4): 753-760, incorporated herein by reference. Isolated subviral particles may also potentially be produced by purification of a corresponding isolated chimeric insect-specific flavivirus, such as hereinbelow described, to remove genetic material from the flavivirus.

Amino Acid Sequence of Proteins Encoded by the Genome of an Insect-Specific Flavivirus As set forth above, the amino acid sequence (i) of the isolated protein of this aspect will be of, or derived from, a protein encoded by the genome of an insect-specific flavivirus (ISF).

With reference to Colmant et al. (2017) mSphere 2(4) pii: e00262-17, it will be appreciated that insect-specific flaviviruses may be classified as 'Lineage I' or 'Lineage II' ISFs. In certain embodiments, the amino acid sequence (i) is of, or derived from, a protein encoded by the genome of a Lineage I ISF. In certain embodiments, the amino acid sequence (i) is of, or derived from, a protein encoded by the genome of a Lineage II ISF.

Preferably, the insect-specific flavivirus encoding said amino acid sequence is capable of infecting a plurality of different insect cells. In preferred embodiments, said insect-specific flavivirus is capable of infecting a plurality of species of insect cells. In particularly preferred embodiments, said first insect-specific flavivirus is capable of infecting a plurality of genera of insect cells.

Figure 11:
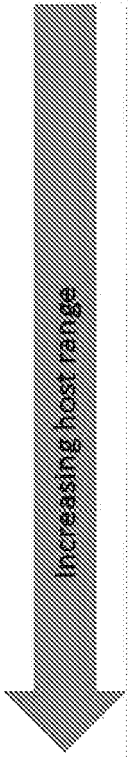
FIG. 11 sets forth host range of various flavivirus types.
Figure 58:
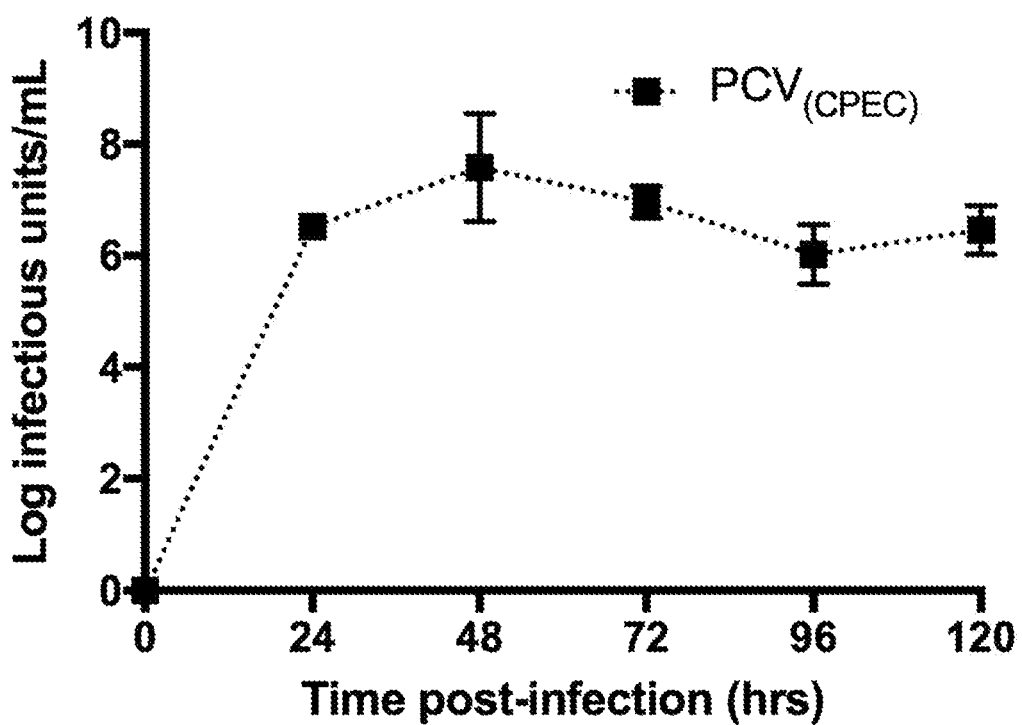
FIG. 58 sets forth a time-course of infection of C6/36 cells by CPEC-derived PCV.

With reference to the examples and FIG. 11, it will be appreciated that the use of an insect-specific flavivirus capable of infecting a plurality of genera of insect cells has been observed to be particularly effective for the production of chimeric insect-specific flaviviruses of the invention, which comprise isolated proteins according to certain preferred embodiments of this aspect. Without being bound by theory, the inventors hypothesize that the use of an amino acid sequence (i) of or derived from a protein encoded by the genome of an insect-specific flavivirus wherein the flavivirus can infect a plurality of genera and/or species of insect cells may be generally desirable for producing isolated insect-specific flaviviruses. Therefore, proteins comprising such sequence are particularly desirable according to this aspect.

Furthermore, without being bound by theory, it is hypothesized that certain properties of the E protein of an insect-specific flavivirus may make the insect-specific flavivirus particularly desirable in this context. In particular, it is hypothesized that use of an amino acid sequence (i) of or derived from a protein encoded by the genome of an insect-specific flavivirus wherein the E protein has similar characteristics as an E protein of a flavivirus that is not insect-specific may be particularly desirable for the production of chimeric insect-specific flaviviruses of the invention.

By way of non-limiting example, said E protein of the insect-specific flavivirus may have the same or similar disulphide bond folding pattern; the same or similar CD loop structure of the EDIII domain; or the same or similar structure of the EDI domain, or EDII domain, as a flavivirus that is not insect-specific, preferably wherein the immunogenic sequence (ii) of the protein of this aspect is of or derived from said flavivirus that is not insect specific.

In certain preferred embodiments, the amino acid sequence (i) is encoded by the genome of a flavivirus that has a mosquito as a native host. Preferably, said mosquito is selected from the group consisting of *Coquillettidia* spp.; *Aedes* spp.; and *Culex* spp.

Preferably, the insect-specific flavivirus of (i) is selected from the group consisting of Palm Creek virus (PCV); Binjari virus (BinJV); Lilly Creek virus (LiCV) and Bamaga virus (BgV). With reference to the Figures and Examples, it will be appreciated that said viruses can infect a plurality of genera and/or species of insect cells. In particular regard to BinJV, it will be appreciated that the E protein of this insect-specific flavivirus has similar characteristics as certain flaviviruses that are not insect-specific (such as Zika virus, West Nile virus, and Dengue virus) amino acid sequence of or derived from which viruses are preferred for use as immunogenic sequences (ii) of the protein of this aspect, as hereinbelow described. Specifically, the E protein of BinJV has substantially the same: disulphide bond folding pattern; structure within the CD loop of EDIII; and EDI structure surrounding the N-linked glycosylation site (notwithstanding the presence of a small deletion), as the E proteins of Zika virus, West Nile virus, and Dengue virus.

In embodiments, the insect-specific flavivirus of (i) may be selected from the group consisting of Parramatta River virus (PaRV), Cell fusing agent virus (CFAV), and Karumba virus (KRBV). With reference to the Figures and Examples, it will be appreciated that infecting by said viruses is restricted to individual mosquito species or genera.

In particularly preferred embodiments, (i) comprises an amino acid sequence set forth in SEQ ID NOS:5-7, or 387, or a fragment, variant, or derivative thereof. In embodiments, (i) may comprise an amino acid sequence set forth in SEQ ID NOS:17-19.

It will be understood that, in certain embodiments, the amino acid sequence (i) of the isolated protein of this aspect may be of, or derived from, a plurality of insect-specific flaviviruses. By way of non-limiting example, the amino acid sequence (i) may be of a plurality of flavivirus subunit proteins, each of which is of or derived from an individual insect-specific flavivirus. Additionally or alternatively, individual subunit protein(s) may be encoded by at least a portion of the amino acid sequence (i) that is of or derived from a plurality of insect-specific flaviviruses.

Immunogenic Sequences

As set forth above, the immunogenic sequence (ii) of the protein of this aspect will not be encoded by the genome of an insect-specific flavivirus.

Immunogenic amino acid sequences of this aspect may be any sequence capable of eliciting an immune response upon administration to an animal. In embodiments, the immune response may be either mucosal, B-lymphocyte or T-lymphocyte mediated, or a combination thereof. Without limitation, the T-lymphocyte mediated response may be a specific cytotoxic T-lymphocyte response. In certain preferred embodiments, the immunogenic sequences may induce a neutralising antibody response. Preferably, the immune response is a protective immune response.

It will be appreciated that the isolated insect-specific flavivirus may include a plurality of immunogenic amino acid sequences (ii). The plurality of isolated immunogenic amino acid sequences may be a plurality of the same immunogenic amino acid sequences, or a plurality of different immunogenic amino acid sequences.

It will also be understood that "spacer" amino acids may be included between one or the plurality of the immunogenic sequences or fragments thereof present in said isolated protein. Such spacer amino acid sequences need not be immunogenic themselves, but may serve to separate one or a plurality of immunogenic sequences from other components of the amino acid sequence of the isolated insect-specific flavivirus according to this aspect.

In preferred embodiments, the immunogenic amino acid sequence (ii) of the protein of this aspect comprises an amino acid sequence of, or derived from, a protein encoded by the genome of a flavivirus that is not insect-specific.

In preferred embodiments, the immunogenic amino acid sequence (ii) is of at least part of a structural protein of a flavivirus that is not insect-specific. Suitably, the structural protein is selected from the group consisting of a Capsid; prM; and Envelope protein. Preferably, the structural protein is a prM protein and/or an Envelope protein.

Additionally or alternatively, the immunogenic amino acid sequence may be of at least part of a non-structural protein of the flavivirus. Suitably, the non-structural protein is selected from the group consisting of an NS1; NS2A; NS2B; NS3; NS4A; NS4B; and NS5 protein. In one particularly preferred alternative embodiment, the non-structural protein is NS1.

In embodiments wherein the immunogenic amino acid sequence (ii) is of protein encoded by the genome of a flavivirus that is not insect-specific, preferably said flavivirus is a vertebrate-infecting flavivirus. More preferably, said flavivirus is a mammal, reptile or avian-infecting flavivirus. In one particularly preferred embodiment, said flavivirus is a human-infecting flavivirus. In one particularly preferred embodiment, said flavivirus is a crocodile-infecting flavivirus.

Preferably, the immunogenic amino acid sequence (ii) is of a protein encoded by the genome of a flavivirus selected from the group consisting of Zika virus (ZIKV); West Nile virus (WNV); Dengue virus (DENY); Japanese encephalitis virus (JEV); Yellow fever virus (YFV); tick-borne encephalitis virus (TBEV), St Louis encephalitis virus (SLEV), Murray valley encephalitis virus (MVEV); Duck tembusu virus; Turkey Meningoencephalitis Virus (TMEV); Usutu virus; Sepik virus; Wesselsbron virus; Baiyangdian Virus (BYD); Sitiawan Virus (SV). Preferably, said flavivirus is selected from the group consisting of Zika virus, West Nile virus; and Dengue virus.

In a preferred embodiment wherein the virus is West Nile virus, the virus is the Kunjin (KUNV) subtype of West Nile virus. In a preferred embodiment wherein the virus is Dengue virus, the virus is Dengue Virus Type 1, 2, 3 or 4.

In particularly preferred embodiments, the immunogenic sequence (ii) of the isolated protein of this aspect is or comprises an amino acid sequence set forth in SEQ ID NOS:8-10, or a fragment, variant, or derivative thereof.

In embodiments wherein the immunogenic sequence (ii) is of a protein encoded by the genome of a flavivirus that is not insect-specific, it is particularly preferred that, within the isolated protein of this aspect, the immunogenic sequence (ii) replaces a corresponding amino acid sequence of the insect-specific flavivirus which genome encodes the amino acid sequence (i).

By way of non-limiting example, in the particularly preferred embodiment of the isolated protein of this aspect set forth in SEQ ID NO:1, as set forth in the examples, the immunogenic sequence (ii) (the prM and Envelope amino acid sequence) encoded by the genome of a human-infecting flavivirus (West Nile virus), has replaced the corresponding prM and Envelope amino acid sequence encoded by the genome of an insect-specific flavivirus (Palm Creek virus).

Without being bound by theory, the inventors hypothesize that the use of an immunogenic sequence (ii) encoded by the genome of a flavivirus that is not insect-specific which replaces a corresponding amino acid sequence within a structural or non-structural protein encoded by the genome of an insect-specific flavivirus in the isolated protein of this aspect may be particularly advantageous for the invention. By way of non-limiting example, it is hypothesized that, at least in some circumstances, this may allow for improved replication of an isolated chimeric insect-specific flavivirus comprising said protein in insect cells and/or the inducement of a desirable immune response in a subject, when the isolated protein, or an isolated chimeric insect-specific flavivirus, or a related virus particle, comprising the protein, is used as or as part of a vaccine. This arrangement is also expected to facilitate the native folding of the immunogenic sequence (ii), e.g. in embodiments wherein said immunogenic sequence is of an E protein and/or prM protein.

In some preferred embodiments, the immunogenic sequence (ii) may be of the EDIII domain of an E protein of the isolated protein of this aspect. Suitably, in these embodiments, the isolated protein comprises an E protein that is chimeric. Preferably, the EDIII domain of the chimeric E protein is an immunogenic sequence (ii) that is of or derived from a vertebrate-infecting flavivirus, and the remainder of the E protein (including the EDI and EDII domains) is of the amino acid sequence (i) encoded by the genome of an insect-specific flavivirus. Alternatively, the EDI and/or the EDII domain of the chimeric E protein may be an immunogenic sequence (ii) that is of or derived from a vertebrate infecting flavivirus, and the remainder of the E protein may be of the amino acid sequence (i) encoded by the genome of an insect-specific flavivirus.

In some preferred embodiments, the immunogenic sequence (ii) may be of a prM protein of the isolated protein of this aspect.

With reference to the Examples, it will be appreciated that isolated proteins of this aspect wherein the immunogenic sequence (ii) is of the EDIII domain of the E protein and/or the prM protein of the isolated protein, may have particularly desirable properties in regard to specificity of the immunogenic sequence. As such, these embodiments of the isolated protein of this aspect may be particularly desirable in the context of diagnostic applications, as hereinbelow described.

Furthermore, it will be appreciated that use of an immunogenic sequence (ii) that is of the EDIII domain and/or the prM protein of the isolated protein of this aspect may facilitate improved or enhanced expression of the immunogenic EDIII domain and/or prM protein, as compared to certain existing recombinant protein expression strategies. As will be understood by the skilled person, recombinant flavivirus prM protein in particular is difficult to express in large quantities using traditional recombinant expression strategies, as it is a membrane anchored protein.

It will nevertheless be understood that the immunogenic sequence (ii) of the isolated protein of this aspect need not necessarily replace a corresponding amino acid sequence of the insect-specific flavivirus which genome encodes the amino acid sequence (i). For example, the immunogenic sequence (ii) may be an addition or insertion to the amino acid sequence (i). By way of elaboration, the immunogenic sequence may be attached to the amino or carboxy terminal of a structural or non-structural protein comprising the amino acid sequence (i), or be inserted within a structural or non-structural protein comprising the amino acid sequence (i).

It will be further appreciated that, although the use of an immunogenic sequence (ii) that is of, or derived from, a protein encoded by the genome of a flavivirus that is not insect-specific is particularly preferred, the use of any other suitable immunogenic amino acid sequences (ii) also falls within the scope of this aspect.

Generally, suitable other sequences for use as the immunogenic amino acid sequence (ii) of the isolated protein of this aspect may include amino acid sequence derived from, of, or corresponding to an immunogen from a pathogenic organism such as a virus, a bacteria, a fungi and a parasite; a cancer immunogen; an allergic reaction immunogen (i.e., an allergen); a transplantation immunogen; or an autoantigen, although without limitation thereto.

Preferably, such other suitable immunogenic amino acid sequences are of a pathogenic organism that causes or is related to or associated with an infectious disease, disorder, or condition of an animal Preferably the animal is a vertebrate, preferably an avian; reptile; or mammal, preferably a human. Said pathogenic organisms include, but are not limited to viral; bacterial; fungal; mycobacterial; and parasitic organisms.

Particularly preferred other suitable immunogenic amino acid sequences are amino acid sequences from a virus. Further to the preferred embodiments wherein the immunogenic amino acid sequence (ii) is of a flavivirus that is not insect-specific, the invention encompasses immunogenic amino acid sequences (ii) of any member of the positive (+) sense RNA Virus group including (and without limitation thereto) any member of the family Astroviridae inclusive of an astrovirus (e.g., a human astrovirus) and an arterivirus (e.g., an equine arteritis virus); any member of the family Caliciviridae inclusive of a Norwalk virus, a Hepatitis E virus; any member of the family Coronaviridae inclusive of Corona Virus and SARS and a torovirus; any member of the family Picornaviridae inclusive of an enterovirus, a rhinovirus (e.g. a human rhinovirus 1A), a hepatovirus (e.g. a hepatitis A virus), a cardiovirus (e.g. a encephalomyocarditis virus) and an aphtovirus (e.g. foot-and-mouth disease virus); any member of the family Togaviridae inclusive of an alphavirus (e.g., a Sindbis virus) and a rubivirus (e.g. a rubella virus).

The invention also encompasses immunogenic amino acid sequences (ii) of any member of the negative (−) sense RNA virus group including (and without limitation thereto) any member of the family Filoviridae inclusive of a filovirus (e.g. Marburg virus, Ebola virus); any member of the family Paramyxoviridae inclusive of a paramyxovirus (e.g. a human parainfluenza virus 1), a morbillivirus (e.g. a measles virus), a rubulavirus (a mumps virus), a Hendra virus and a Nipah virus; any member of the family Pneumovirinae inclusive of a pneumovirus (eg. a human respiratory syncytial virus); any member of the family Rhabdoviridae inclusive of a vesiculovirus (e.g. a vesicular stomatitis virus, Indiana virus), a lyssavirus (e.g. a rabies virus) and an ephemerovirus (e.g. a bovine ephemeral fever virus); any member of the ambisense RNA virus group inclusive of any member of the family Arenaviridae such as an arenavirus (e.g. lymphocytic choriomeningitis virus); any member of the family Bunyaviridae inclusive of a bunyavirus (e.g. Bunyamwera virus) and a hantavirus (e.g. a Hantaan virus); any member of the family Orthomyxoviridae inclusive of an influenzavirus A (such as an influenza A virus, an avian influenza A virus), an influenzavirus B (such as an influenza B virus), an influenzavirus C (such as an influenza C virus) and a "Thogoto-like viruses" (e.g. Thogoto virus).

The invention also encompasses immunogenic amino acid sequences (ii) of any member of the dsRNA Viruses group including (and without limitation thereto) any member of the family Birnaviridae inclusive of an aquabirnavirus (e.g., an infectious pancreatic necrosis virus) and an avibirnavirus (e.g., infectious bursal disease virus); any member of the family Reoviridae inclusive of an orthoreovirus (e.g., a reovirus 3), a orbivirus (e.g., a bluetongue virus 1), a rotavirus, a coltivirus (e.g., a Colorado tick fever virus and an aquareovirus.

The invention also encompasses immunogenic amino acid sequences (ii) of any member of the RNA Reverse Transcribing Viruses group including any member of the family Retroviridae inclusive of a mammalian type B retrovirus (e.g. a mouse mammary tumor virus), a mammalian type C retrovirus (e.g. a murine leukemia virus), an avian type C retrovirus (e.g. a avian leukosis virus), a type D retrovirus (eg a Mason-Pfizer monkey virus), a BLV-HTLV retrovirus (e.g. a bovine leukemia virus), a lentivirus (e.g. a human immunodeficiency virus 1) and a spumavirus (e.g. a human spumavirus). The invention also encompasses immunogenic amino acid sequences (ii) of any member of the dsDNA Viruses group including (and without limitation thereto) any member of the family Adenoviridae inclusive of a mastadenovirus (eg, a human adenovirus) and an aviadenovirus (eg, a fowl adenovirus), although without limitation thereto; any member of the family Herpesviridae inclusive of an Alphaherpesvirinae such as, but not limited to, a simplexvirus (e.g., a human herpesvirus 1) and a varicellovirus (e.g. a human herpesvirus 3); a Betaherpesvirinae such as, but not limited to, a cytomegalovirus (e.g., human herpesvirus 5), a muromegalovirus (e.g., a mouse cytomegalovirus 1), a roseolovirus (e.g., a human herpesvirus 6); a Gammaherpesvirinae such as, but not limited to, a lymphocryptovirus (e.g., a human herpesvirus 4), a rhadinovirus (e.g., an ateline herpesvirus 2); any member of the family Papillomaviridae inclusive of a papillomavirus, preferably human papillomavirus, and preferably subtypes 16, 18, 31, 33, 35, 39, 45, 51, 52, 56, 58, and 59, although without limitation thereto; any member of the family Iridoviridae inclusive of a ranavirus and such as, epizootic haematopoietic necrosis virus, but not limited to; any member of the family Polyomaviridae inclusive of a polyomavirus and preferably murine polymavirus; any member of the family Poxviridae inclusive of an orthopoxvirus (e.g., a vaccinia virus), a parapoxvirus (e.g., a orf virus), an avipoxvirus (e.g., a fowlpox virus), an capripoxvirus (e.g., a sheep pox virus), a leporipoxvirus (e.g., a myxoma virus) and a suipoxvirus (e.g., a swinepox virus).

The invention also encompasses immunogenic amino acid sequences (ii) of any member of any member of the ssDNA Viruses group including (and without limitation thereto) any member of the family Parvoviridae inclusive of a parvovirus (e.g., Rheumatoid arthritis virus, B19).

The invention also encompasses immunogenic amino acid sequences (ii) of any member of the DNA Reverse Transcribing Viruses group including any member of the family Hepadnaviridae inclusive of an orthohepadnavirus (e.g. a hepatitis B virus) and an avihepadnavirus (e.g. a duck hepatitis B virus), although without limitation thereto.

Nucleic Acids Encoding Amino Acid Sequences of Isolated Proteins

A related aspect of the invention provides an isolated nucleic acid encoding the amino acid sequence of the isolated protein of the preceding aspect.

In certain particularly preferred embodiments, the isolated nucleic acid of this aspect is an isolated nucleic acid encoding the amino acid sequence set forth in SEQ ID NOS:1-4 or SEQ ID NOS:32, 389, 391 or 395 or a fragment, variant, or derivative thereof.

In certain embodiments, the isolated nucleic acid of this aspect is an isolated nucleic acid encoding the amino acid sequence set forth in SEQ ID NOS:20, 22, 24, 26, 28, 30, 384, 393, 397, or 402-405, or a fragment or variant thereof.

In certain embodiment, the isolated nucleic acid of this aspect comprises the nucleotide sequence set forth in SEQ ID NOS:11, 12, 13, 14, 21, 23, 25, 26, 27, 29, 31, 33, 385, 386, 388, 390, 392, 394, 396, or 398-401.

The isolated nucleic acid of this aspect will comprise a nucleotide sequence of an insect-specific flavivirus; and a nucleotide sequence encoding an immunogenic amino acid sequence, wherein the immunogenic nucleotide sequence is not of an insect-specific flavivirus.

Preferably, the nucleotide sequence of the isolated nucleic acid of this aspect that is of the insect-specific flavivirus is of an insect-specific flavivirus capable of infecting a plurality of different insects. In certain preferred embodiments, said insect-specific flavivirus has a native host selected from the group consisting of *Coquillettidia* spp.; *Aedes* spp.; *Anopheles* spp.; *Mansonia* spp.; *Toxorhynchites* spp. and *Culex* spp.

Preferably, the insect-specific flavivirus of (i) is selected from the group consisting of PCV; BJV; BgV; and LiCV. In embodiments, the insect-specific flavivirus of (i) may be selected from the group consisting of PRV; CFAV; and KRBV.

In particularly preferred embodiments, the nucleotide sequence of the isolated nucleic acid of this aspect that is of the insect-specific flavivirus comprises a nucleotide sequence encoding an amino acid sequence set forth in SEQ ID NOS:5-7 or 387, or a fragment or variant thereof. Exemplary nucleotide sequences encoding the amino acid sequences set forth in SEQ ID NOS:5-7 and 387 are set forth in SEQ ID NOS:39-41 and 386, respectively.

In embodiments, the nucleotide sequence of the isolated nucleic acid of this aspect that is of the insect-specific flavirus comprises a nucleotide sequence encoding an amino acid sequence set forth in SEQ ID NOS:17-19, or a fragment or variant thereof. Exemplary nucleotide sequences encoding the amino acid sequences set forth in SEQ ID NOS:17-19 are set forth in SEQ ID NOS:42-44, respectively.

In preferred embodiments of the isolated nucleic acid of this aspect, the nucleotide sequence that encodes the immunogenic amino acid sequence encodes at least part of a protein of a flavivirus that is not insect-specific.

In preferred embodiments, said immunogenic amino acid sequence is of at least part of a structural protein of a flavivirus that is not insect-specific. Suitably, the structural protein is selected from the group consisting of a Capsid; prM; and Envelope protein. Preferably, the structural protein is a prM protein and/or an Envelope protein.

Additionally or alternatively, said nucleotide sequence encoding the immunogenic amino acid sequence may encode at least part of a non-structural protein of the insect-specific flavivirus producible by the vector. Suitably, the non-structural protein is selected from the group consisting of an NS1; NS2A; NS2B; NS3; NS4A; NS4B; and NS5 protein.

Preferably, said nucleotide sequence of the isolated nucleic acid of this aspect encoding the immunogenic amino acid sequence encodes an immunogenic amino acid sequence of a flavivirus selected from the group consisting of ZIKV; WNV; Dengue; JEV; YFV; TBEV, SLEV, MVEV; Duck tembusu virus; TMEV; Usutu virus; Sepik virus; Wesselsbron virus; BYD; and SV. In a particularly preferred embodiment, said virus is selected from the group consisting of West Nile virus; Zika virus; and Dengue virus.

In particularly preferred embodiments, said nucleotide sequence that encodes the immunogenic amino acid sequence is or comprises a nucleotide sequence encoding an amino acid set forth in SEQ ID NOS:8-10, or a fragment or variant thereof. Exemplary nucleotide sequences encoding the amino acid sequences set forth in SEQ ID NOS:8-10 are set forth in SEQ ID NOS:43-45, respectively.

It will be understood that the isolated nucleic acid according to this aspect may, but need not necessarily, be capable of replicating an isolated chimeric insect-specific flavivirus comprising the isolated protein of the directly preceding aspect. As used herein, an isolated nucleic acid that is "capable of replicating" an isolated chimeric insect-specific flavivirus will be understood to be a nucleic acid that can, at least under certain circumstances, be used to produce a complete, functioning, isolated chimeric insect-specific flavivirus.

As will be readily understood by the skilled person, viral replication occurs in a suitable host cell relying upon the host cell machinery. For an overview of viral replication, the skilled person is directed to Carter and Saunders, *Virology: Principles and Applications*, John Wiley & Sons Inc (New York, 2013), incorporated herein by reference. Generally, viral replication involves steps of (a) expression of viral proteins, including structural and non-structural proteins, from the viral genetic material; (b) replication of the viral genetic material; and (c) packaging of the replicated viral genetic material into the viral structural proteins.

For the purposes of this invention, an isolated nucleic acid that is "capable of replicating" an isolated chimeric insect-specific flavivirus will be understood to refer to an isolated nucleic acid that, when combined with a suitable host cell, results in the replication of the flavivirus. Examples of approaches to combine the isolated nucleic acid with the suitable host cell include direct transfection of the host cell with the isolated nucleic acid, including stable and transient transfection as are well known in the art, and/or transcription of the nucleic acid within the host cell, e.g. from a suitable vector as hereinbelow described.

Also provided according to the invention are genetic constructs comprising the isolated nucleic acid of this aspect. Suitably, the genetic construct may be in the form of, or comprise genetic components of, a plasmid, bacteriophage, a cosmid, a yeast or bacterial artificial chromosome as are well understood in the art. Genetic constructs may be suitable for maintenance and propagation of an isolated nucleic acid in bacteria or other host cells, for manipulation by recombinant DNA technology and/or expression of the nucleic acid or an encoded protein as herein described.

For the purposes of host cell expression, the genetic construct may be an expression construct. Suitably, the expression construct comprises one or more nucleic acids or variants described herein operably linked to one or more additional sequences in an expression vector.

An "expression vector" may be either a self-replicating extra-chromosomal vector such as a plasmid, or a vector that integrates into a host genome.

By "operably linked" is meant that said additional nucleotide sequence(s) is/are positioned relative to the nucleic acid of the invention preferably to initiate, regulate or otherwise control transcription.

In one embodiment, the additional nucleotide sequences are regulatory sequences. Regulatory nucleotide sequences will generally be appropriate for the host cell used for expression. Numerous types of appropriate expression vectors and suitable regulatory sequences are known in the art for a variety of host cells.

Typically, said one or more regulatory nucleotide sequences may include, but are not limited to, promoter sequences, leader or signal sequences, ribosomal binding sites, transcriptional start and termination sequences, translational start and termination sequences, and enhancer or activator sequences.

Constitutive or inducible promoters as known in the art may be used for genetic constructs of the invention. The promoters may be either naturally occurring promoters, or hybrid promoters that combine elements of more than one promoter.

In certain embodiments, the genetic construct of this aspect may comprise one or more small RNA target sequences.

As used herein, "small RNA" will be understood to refer to small, non-coding RNA molecules that have the capacity to bind to and regulate the expression, translation and/or replication of other nucleic acid molecules. The skilled person is directed to Ipsaro, J. J., & Joshua-Tor, L., 2015, *Nature Struc. & Mol. Biol.* 22 20 for a summary of summary of small RNAs. By way of non-limiting example, the skilled person will appreciate that small RNAs encompasses molecules referred to as 'microRNA', 'miRNA', or 'siRNA'. However, it will be understood that all similar such molecules are included within the scope of small RNA as used herein.

A "small RNA target" will be understood to refer to a nucleotide sequence that is bound by or otherwise interacts with a small RNA, to facilitate regulation of a nucleic acid comprising said sequence.

In certain preferred embodiments, the small RNA target is a microRNA target.

In embodiments wherein the genetic construct includes a small RNA target, the small RNA target will suitably be adapted to regulate or otherwise modulate or control production or translation of a protein of the preceding aspect that is encoded by the genetic construct, and/or an isolated chimeric insect-specific flavivirus comprising said protein, in a cell. Preferably, the cell is an insect cell. Preferably the insect cell is a mosquito cell.

By way of example, the small RNA target may be adapted to be bound by small RNAs known to be produced in particular cell types, such as mosquito cells (although without limitation thereto). It will be appreciated that binding of the small RNA target in said cell types will typically constrain or prevent replication of a genetic construct comprising the small RNA target, a protein encoded by said genetic construct, and/or a chimeric insect-specific flavivirus comprising said nucleic acid and/or protein, in the cell.

In particularly preferred embodiments, the small RNA target is adapted to constrain or prevent translation of a protein of the preceding aspect, and/or replication of an isolated chimeric insect-specific flavivirus comprising said protein, in the midgut of a mosquito.

Host cells comprising genetic constructs as described above are also provided according to the invention. The host cell will typically be for nucleic acid and/or protein expression, and may be any suitable prokaryotic or eukaryotic cell, as are well-known in the art. For an overview of strategies for recombinant expression in host cells, the skilled person is directed to Lorence, *Recombinant Gene Expression: Reviews and Protocols*, Human Press (2011), incorporated herein by reference.

Isolated Chimeric Insect-Specific Flaviviruses

A further aspect of the invention provides an isolated chimeric insect-specific flavivirus comprising the isolated protein; and the isolated nucleic acid that is capable of replicating the isolated chimeric insect-specific flavivirus, of the preceding aspects.

As hereinabove described, the isolated chimeric insect-specific flavivirus will be capable of infecting a suitable insect host and/or growing and replicating in suitable insect cell lines, but will not infect and/or grow or replicate, or will at least demonstrate substantially restricted ability to infect and/or grow or replicate, in at least wild type vertebrate cell lines.

In embodiments, the isolated chimeric insect-specific flavivirus comprises a genome consisting of or comprising a nucleotide sequence set forth in SEQ ID NOS: 11, 12, 13, 14, 21, 23, 25, 26, 27, 29, 31, 33, 385, 386, 388, 390, 392, 394, 396, or 398-401, or a fragment or variant thereof; and/or an isolated protein consisting of or comprising an amino acid sequence encoded by a nucleotide sequence set forth in SEQ ID NOS: 11, 12, 13, 14, 21, 23, 25, 26, 27, 29, 31, 33, 385, 386, 388, 390, 392, 394, 396, or 398-401, or a fragment or variant thereof.

In embodiments, the isolated chimeric insect-specific flavivirus comprises an isolated protein consisting of or comprising an amino acid sequence set forth in SEQ ID NOS:1-4, 32, 389, 391 or 395 or a fragment, variant, or derivative thereof; and/or a genome consisting of or comprising a nucleotide sequence set forth in SEQ ID NOS:11-14 or 33, 388, 390, or 394, or a fragment or variant thereof.

In embodiments, the isolated chimeric insect-specific flavivirus may comprise an isolated protein consisting of or comprising an amino acid sequence set forth in SEQ ID NOS:20, 22, 24, 26 28, 30, 384, 393, 397, or 402-405, or a fragment, variant, or derivative thereof; and/or a genome consisting of or comprising a nucleotide sequence set forth in SEQ ID NOS:21, 23, 25, 27, 29, 31, 385, 392, 396, 398, 399, or a fragment or variant thereof.

Vectors Capable of Replicating Insect-Specific Flaviviruses

In a further aspect, the invention provides a vector comprising:

(i) the isolated nucleic acid of the above described aspect; and (ii) an insect-specific promoter operably connected to the isolated nucleic acid (i).

The term "operably connected" is used in this context to mean that the insect-specific promoter (ii) is positioned to initiate, regulate or otherwise control transcription of (i). Suitably, the insect-specific promoter is capable of controlling transcription of (i) in an insect cell.

In particularly preferred embodiments, the vector of this aspect is or comprises a nucleotide sequence set forth in SEQ ID NOS:11-14 or 33, or a fragment or variant thereof. In embodiments, the vector of this aspect is or comprises a nucleotide sequence set forth in SEQ ID NOS:21, 23, 25, 27, 29, 31, or 385.

In preferred embodiments of this aspect, the isolated nucleic acid (i) is capable of replicating an isolated chimeric insect-specific flavivirus according to the directly preceding aspect.

Without limitation thereto, preferred vectors of this aspect of the invention are particularly adapted for transfection into insect cells, wherein (i) is transcribed under the control of (ii), and a chimeric insect-specific flavivirus replicable by (i) subsequently replicates within the insect cell.

In some embodiments, the vector comprises one or more small RNA target sequences as hereinabove described, for regulation of replication of an isolated chimeric insect-specific flavivirus in one or more cells. Preferably, said cells are insect cells, preferably mosquito cells. Preferably, the one or more small RNA sequences prevent or constrain replication of the chimeric insect-specific flavivirus in one or more cells of the midgut of a mosquito. Preferably, the inclusion of the small RNA target sequence in the vector of this aspect prevents or constrains replication of the chimeric insect-specific flavivirus in a mosquito, upon ingestion of the vector or a chimeric insect-specific flavivirus comprising the vector, by a mosquito.

Insect-Specific Promoters

In preferred embodiments of this aspect, the insect-specific promoter (ii) of the vector is of an insect virus.

As set forth in the examples, the inventors have discovered that the use of an insect-specific promoter from an insect virus can facilitate transcription to initiate replication of insect-specific flaviviruses in insect cells upon transfection of the insect cells with a vector encoding the ISF.

In certain preferred embodiments, the insect-specific promoter of (ii) is of an insect virus selected from the group consisting of *Orgyia pseudotsugata* multicapsid nucleopolyhedrosis virus (OpMNPV); *Autographa californica* nucleopolyhedrovirus (AcMNP); and *Spodoptera exigua* multiple nucleopolyhedrovirus (SeMNPV).

In certain preferred embodiments, the insect-specific promoter of (ii) is a promoter of an insect virus gene selected from the group consisting of an immediate-early 2 (IE2) gene; a polyhedrin gene; a p10 gene; and an orf46 gene.

In preferred embodiments, the insect promoter (ii) is or comprises a nucleotide sequence set forth in SEQ ID NOS: 15-16 or SEQ ID NOS:382-383.

In certain particularly preferred embodiments, the insect promoter comprises the nucleotide sequence of the OpIE2 promoter set forth in SEQ ID NO:15, or a fragment or variant thereof. Preferably, the insect promoter comprises a fragment of the nucleotide sequence of the OpIE2 promoter set forth in SEQ ID NO:15. Preferably, said fragment features a deletion of one or more consecutive nucleotides relative to SEQ ID NO:15. Preferably said one or more consecutive nucleotides are located 3' of the transcriptional start site of SEQ ID NO:15. Preferably, said fragment features of deletion of 1, 2, 3, 4, 5, 6, 7, 8, 9, 10, 11, 12, 13, 14, 15, 16, 17, 18, 19, 20, 21, 22, 23, or 24 nucleotides from the 3' end of SEQ ID NO:15.

In one particularly preferred embodiment, the insect promoter of (ii) comprises SEQ ID NO:16, which is referred to herein as OpIE2-CA. With reference to the examples, it will be appreciated that use of the insect promoter set forth in SEQ ID NO:16 resulted in particularly effective replication of insect-specific flaviviruses in insect cells when transcription of the virus was driven by the promoter of a vector of this aspect.

Methods of Producing Vectors

The invention further provides a method of producing a vector, the method including the step of operably connecting the isolated nucleic acid of the previously described aspect with an insect-specific promoter, to thereby produce the vector.

Preferably, the vector produced according to the method of this aspect is the vector of the directly preceding aspect.

In preferred embodiments, the method of producing a vector according to this aspect includes the step of joining at least two nucleic acids using a nucleic acid sequence amplification technique, to thereby produce the vector.

As used herein "nucleic acid sequence amplification" includes but is not limited to techniques such as polymerase chain reaction (PCR) as for example described in Chapter 15 of CURRENT PROTOCOLS IN MOLECULAR BIOLOGY Eds. Ausubel et al. (John Wiley & Sons NY USA 1995-2001); strand displacement amplification (SDA); rolling circle replication (RCR) as for example described in International Application WO 92/01813 and International Application WO 97/19193; nucleic acid sequence-based amplification (NASBA) as for example described by Sooknanan et al. 1994, Biotechniques 17 1077; ligase chain reaction (LCR) as for example described in International Application WO89/09385 and Chapter 15 of CURRENT PROTOCOLS IN MOLECULAR BIOLOGY supra; Q-β replicase amplification as for example described by Tyagi et al., 1996, Proc. Natl. Acad. Sci. USA 93 5395; and helicase-dependent amplification as for example described in International Publication WO 2004/02025.

In a particularly preferred embodiment, the nucleic acid sequence amplification technique is a Circular Polymerase Extension Cloning (CPEC) technique, as described in Quan and Tian (2009) *PLOS ONE*, 4(7): e6441, incorporated herein by reference.

It will be appreciated that CPEC, while using a PCR protocol, can achieve ligation of fragments in a single cycle of PCR without amplification, in a strict sense, occurring. As such, as used herein, a "nucleic acid sequence amplification" technique will be understood to encompass a protocol capable of amplifying a nucleic acid, but that does not necessarily result in amplification sensu stricto.

Preferably, the method of producing a vector according to this aspect includes the step of joining a nucleic acid comprising the insect-specific promoter with at least one nucleic acid of the previously described aspect.

In preferred embodiments, the method includes the step of joining a nucleic acid comprising the insect-specific promoter with a plurality of nucleic acids which together form a preferred nucleic acid of the previously described aspect. Preferably, said nucleic acid is capable of replicating a chimeric insect-specific flavivirus.

In these embodiments, preferably, each of the plurality of nucleic acids encodes at least part of a protein of the chimeric insect-specific flavivirus. The components of the chimeric insect-specific flavivirus suitably include structural and non-structural insect-specific flavivirus proteins (as hereinabove described); and an immunogenic amino acid sequence.

The immunogenic sequence will be in a suitable form as hereinabove described. In preferred embodiments, the immunogenic sequence is of one or more structural or non-structural proteins of a flavivirus that is not insect-specific. In particularly preferred embodiments, the immunogenic sequence is of one or more structural proteins of a flavivirus that is not insect-specific.

Preferably, each of the plurality of nucleic acids that is joined according to the method of this aspect comprises nucleotide sequence overlap with respect to an adjacent nucleic acid. With reference to the examples, it will be appreciated that such an arrangement can facilitate effective joining of the nucleic acids using a nucleic acid amplification technique, such as CPEC.

With reference to the examples, it will be appreciated that particularly preferred vectors of the invention, such as the vector comprising the nucleotide sequence set forth in SEQ ID NO:11, were constructed by joining five nucleic acids using a CPEC technique, the nucleic acids respectively comprising:

(I) a nucleic acid comprising an insect promoter flanked by respective portions of the 3' and 5' UTRs of Palm Creek virus;

(II) a nucleic acid encoding a portion of the 5' UTR, and the Capsid protein of Palm Creek virus, and prM; and Envelope proteins of West Nile virus;

(III) a nucleic acid encoding NS1; NS2A; and NS2B proteins of Palm Creek virus;

(IV) a nucleic acid encoding NS3; NS4A; and NS4B flavivirus proteins of Palm Creek virus; and (V) a nucleic acid encoding NS5 protein and a portion of the 3' UTR of Palm Creek virus, wherein:

(I) comprises nucleotide sequence overlap with (V) and (II);

(II) comprises nucleotide sequence overlap with (I) and (III);

(III) comprises nucleotide sequence overlap with (II) and (IV);

(IV) comprises nucleotide sequence overlap with (III) and (V); and (V) comprises nucleotide sequence overlaps with (IV) and (I).

It will be appreciated that, in the particularly preferred embodiments illustrated in Example 8, the immunogenic amino acid sequence encoded by the vector is in the form of the prM and Envelope proteins encoded by (II), and the amino acid sequence of the insect-specific flavivirus is in the form of the Capsoid protein encoded by (II) and the non-structural proteins encoded by (III)-(V).

A related aspect provides a vector produced according to the method of this aspect.

Proteins and Chimeric Insect-Specific Flaviviruses Produced from Vectors

Further aspects of the invention provide an isolated protein or isolated chimeric insect-specific flavivirus, respectively, produced from a vector encoding according to the directly preceding aspects.

An isolated protein may be produced from said vector by any suitable approach, such as hereinabove described in relation to expression vectors generally.

Typically, the production of an isolated chimeric insect-specific flavivirus from said vector will require transfection of a suitable cell with the vector, wherein transcription of the nucleotide sequence of the previously described aspect with is capable of replicating a chimeric insect-specific flavivirus occurs, followed by replication of the insect-specific flavivirus in the host cell.

As hereinabove described, chimeric insect-specific flaviviruses of the invention do not replicate, or at least demonstrate substantially restricted replication in at least wild type vertebrate cells. As such, cells used for production of the isolated insect-specific flavivirus according to this aspect will typically be insect cells. However, at least for some ISFs, it has been demonstrated that some degree (typically trace amounts) of replication can occur in certain mutant vertebrate cells (e.g. Tree et al. (2016) *Virology*, 497, 81-91, incorporated herein by reference). As such, in some cases, production of insect-specific flaviviruses according to the method of this aspect may be performed by transfection of suitably mutant non-insect cells, e.g. mutant vertebrate cells.

Methods of Producing Chimeric-Insect Specific Flaviviruses from Vectors Using Insect Cells A further aspect of the invention provides a method of producing an isolated chimeric insect-specific flavivirus comprising an isolated protein of the above-described aspect, the method including the steps of:

(a) combining a vector comprising (i) a nucleotide sequence capable of replicating a chimeric insect-specific flavivirus comprising the isolated protein of above-described aspect; and (ii) an insect-specific promoter operably connected to (i), with an insect cell; and (b) allowing the chimeric insect-specific flavivirus replicable by (i) to replicate in the insect cell, to thereby produce the isolated chimeric insect-specific flavivirus.

Suitably, combining the vector with the insect cell according to this aspect is in the form of transfection of the insect cell with the vector.

In some preferred embodiments, the insect cell according to this aspect is a mosquito cell. In preferred embodiments, the mosquito cell is an *Aedes albopictus* cell, preferably C6/36 or C7/10.

In a particularly preferred embodiment, the mosquito cell is a C3/36 cell.

In some preferred embodiments, the insect cell according to this aspect is a fly cell. Preferably, the fly cell is a fruit fly cell, preferably a *Drosophila* cell. Preferably, the *Drosophila* cell is an S2 cell.

In preferred embodiments of the method of this aspect, the flavivirus is produced in the insect cell at a titre of at least: $10^4$/ml; $10^5$/ml; $10^6$/ml; $10^7$/ml; or $10^8$/ml. In one particularly preferred embodiment, the flavivirus is produced in the insect cell at a titre of greater than $10^7$/ml.

As set out in the examples, certain preferred vectors of the invention comprising a nucleotide sequence capable of replicating chimeric insect-specific flavivirus comprising ISF virus proteins and an immunogenic sequence in the form of proteins of a flavivirus that is not insect-specific were produced by transfection of insect cells with the vector. Subsequently, substantial replication of the chimeric insect-specific flavivirus in the insect cells was observed.

By way of example, for PCV/WNV$_{KUN}$-prME (SEQ ID NO:1), the isolated chimeric insect-specific flavivirus was produced at a titre of $1.7 \times 10^6$/ml. For PCV/ZIKA-prME (SEQ ID NO:2), the isolated chimeric insect-specific flavivirus was produced at a titre of $3.9 \times 10^7$/ml. For PCV/DENV2-prME (SEQ ID NO:3), the isolated chimeric insect-specific flavivirus was produced at a titre of $3.6 \times 10^5$/ml.

A related aspect provides an isolated chimeric insect-specific flavivirus produced according to the method of this aspect.

Modified Chimeric Insect-Specific Flaviviruses, and Proteins and Nucleic Acids Thereof A further aspect of the invention provides a method of modifying a chimeric insect-specific flavivirus, a protein of a chimeric insect-specific flavivirus, and/or a nucleic acid of a chimeric insect-specific flavivirus, including the step of replicating a chimeric insect-specific flavivirus in a cell, whereby one or more mutations are incorporated into the chimeric insect-specific flavivirus, a protein thereof, and/or a nucleotide sequence thereof, to thereby modify the chimeric insect-specific flavivirus, protein thereof, and/or nucleic acid thereof.

Preferably, the step of replicating the chimeric insect-specific flavivirus according to the method of this aspect includes a plurality of replication cycles. Said plurality of replication cycles may suitably be in the form of 'serial passaging' of the chimeric insect-specific flavivirus, as is known in the art.

Preferably, the chimeric insect-specific flavivirus is replicated in an insect cell, preferably a mosquito cell, such as herein described, e.g. C6/36 or C7/10 cells, although without limitation thereto.

Preferably, the method of this aspect improves or enhances efficiency of replication of the chimeric insect specific flavivirus in one or more cells. Preferably, said one or more cells are insect cells, preferably mosquito cells.

With reference to Example 18, it will be appreciated that serial passaging of a chimeric insect-specific flavivirus as described herein in mosquito cells resulted in accumulation in mutations in the nucleotide sequence of the chimeric insect-specific flavivirus (cf. SEQ ID NOS:400 and 401). Additionally, as set forth in FIG. 86, increased efficiency of replication of serially passaged chimeric insect-specific flaviviruses in mosquito cells was observed.

Related aspects of the invention provide isolated modified chimeric-insect specific flaviviruses, isolated proteins, and isolated nucleic acids produced according to the method of this aspect.

Compositions Comprising Isolated Proteins and/or Chimeric Insect-Specific Flaviviruses Still another aspect of the invention provides a composition comprising an isolated protein and/or an isolated chimeric insect-specific flavivirus of the preceding aspects.

In some embodiments of this aspect, the composition is a pharmaceutical composition. In these embodiments, the one or more carriers, diluents, or excipients will be pharmaceutically acceptable carriers, diluents, or excipients.

By "pharmaceutically-acceptable carrier, diluent or excipient" is meant a solid or liquid filler, diluent or encapsulating substance that may be safely used in systemic administration to a subject.

Depending upon the particular route of administration, a variety of carriers, well known in the art, may be used. These carriers may be selected from the group including sugars, starches, cellulose and its derivatives, malt, gelatine, talc, calcium sulphate, vegetable oils, synthetic oils, polyols, alginic acid, phosphate buffered solutions, emulsifiers, isotonic saline and salts such as mineral acid salts including hydrochlorides, bromides and sulphates, organic acids such as acetates, propionates and malonates and pyrogen-free water. A useful reference describing pharmaceutically acceptable carriers, diluents and excipients is Remington's Pharmaceutical Sciences (Mack Publishing Co. N.J. USA, 1991) which is incorporated herein by reference.

Dosage forms of compositions according to this aspect include tablets, dispersions, suspensions, injections, solutions, oils, syrups, troches, capsules, suppositories, aerosols, transdermal patches and the like. These dosage forms may also include injecting or implanting controlled releasing devices designed specifically for this purpose or other forms of implants modified to act additionally in this fashion. Controlled release of the therapeutic agent may be effected by coating the same, for example, with hydrophobic polymers including acrylic resins, waxes, higher aliphatic alcohols, polylactic and polyglycolic acids and certain cellulose derivatives such as hydroxypropylmethyl cellulose. In addition, the controlled release may be effected by using other polymer matrices, liposomes and/or microspheres.

Compositions of the present invention suitable for enteral, oral or parenteral administration may be presented as discrete units such as capsules, sachets or tablets each containing a pre-determined amount of one or more therapeutic agents of the invention, as a powder or granules or as a solution or a suspension in an aqueous liquid, a non-aqueous liquid, an oil-in-water emulsion or a water-in-oil liquid emulsion. Such compositions may be prepared by any of the methods of pharmacy but all methods include the step of bringing into association one or more agents as described above with the carrier which constitutes one or more necessary ingredients. In general, the compositions are prepared by uniformly and intimately admixing the agents of the invention with liquid carriers or finely divided solid carriers or both, and then, if necessary, shaping the product into the desired presentation.

Preferably, the pharmaceutical composition of this aspect is a vaccine.

In some embodiments, the composition of this aspect is a diagnostic composition. The diagnostic composition may be for in vivo or in vitro use. Preferably, the diagnostic composition is for in vitro use.

The diagnostic composition may comprise one or more buffers, solutions, blocking agents, and/or detection reagents as are well known in the art. In some embodiments, the diagnostic composition may be in kit form. Kits may include the isolated protein and/or isolated chimeric insect-specific flavivirus of the preceding aspects and one or more of detection reagents (e.g enzymes and substrates, digoxigenin); secondary antibodies (optionally labelled); buffers, solutions and blocking agents; and/or labels selected from a group including an enzyme, a fluorophore, a chemiluminescent molecule, biotin, radioisotope or any other suitable label. Examples of suitable enzyme labels useful in the present invention include alkaline phosphatase, horseradish peroxidase, luciferase, β-galactosidase, glucose oxidase, lysozyme, malate dehydrogenase and the like. The enzyme label may be used alone or in combination with a second enzyme in solution or with a suitable chromogenic or chemiluminescent substrate.

Examples of chromogens include diaminobanzidine (DAB), permanent red, 3-ethylbenzthiazoline sulfonic acid (ABTS), 5-bromo-4-chloro-3-indolyl phosphate (BCIP), nitro blue tetrazolium (NBT), 3,3',5,5'-tetramethyl benzidine (TNB) and 4-chloro-1-naphthol (4-CN), although without limitation thereto.

A non-limiting example of a chemiluminescent substrate is Luminol™, which is oxidized in the presence of horseradish peroxidase and hydrogen peroxide to form an excited state product (3-aminophthalate).

Fluorophores may be fluorescein isothiocyanate (FITC), tetramethylrhodamine isothiocyanate (TRITC), allophycocyanin (APC), Texas Red (TR), Cy5 or R-Phycoerythrin (RPE), although without limitation thereto.

Radioisotope labels may include $^{125}I$, $^{131}I$, $^{51}Cr$ and $^{99}Tc$, although without limitation thereto.

Other antibody labels that may be useful include colloidal gold particles and digoxigenin.

In one particularly preferred embodiment wherein the diagnostic composition is for in vitro use, the composition is for use in performing an Enzyme-Linked Immunosorbent Assay (ELISA), such as a direct or indirect ELISA. Suitably compositions for use in ELISA are well known to those skilled in the art; for an overview of ELISA reagents and protocols the skilled person is directed to Crowther, *Methods in Molecular Biology*, Volume 42: ELISA, Theory and Practice, Humana Press, (New Jersey, 1995), incorporated herein by reference.

In one particularly preferred embodiment wherein the diagnostic composition is for in vitro use, the composition is for use in performing a lateral flow immunoassay. As will be understood by the skilled person, generally, lateral flow assays involve movement of liquid sample containing an analyte of interest, typically by capillary action, across a test strip containing molecules (such as antibodies) capable of interacting with the analyte. For an overview of lateral flow immonassays and suitable reagents and protocols, the skilled person is directed to Koczula and Gallotta (2016) *Essays in Biochemistry* 60: 111-120, incorporated herein by reference.

Therapeutic Methods Comprising Administration of Insect-Specific Flaviviruses

An aspect of the invention provides a method of eliciting an immune response in a subject, the method including the step of administering an effective amount of the isolated chimeric insect-specific flavivirus or pharmaceutical composition comprising the same as described herein to subject, to thereby elicit an immune response in the subject.

By "elicits or eliciting an immune response" means inducing, activating or stimulating one or more components or elements of the immune system of an animal. The one or more components or elements of the immune system may be of the innate and/or adaptive immune systems, including cellular components (e.g lymphocytes, antigen presenting cells, dendritic cells, myelomonocytic cells) and/or molecular components (e.g. cytokines, chemokines, antibodies), although without limitation thereto.

In some embodiments, the immune response is a protective immune response which is responsive to subsequent challenge or infection by a pathogen.

Accordingly a related aspect of the invention provides a method of immunizing a subject against a pathogen, the method including the step of administering an effective amount of the pharmaceutical composition of the thirteenth aspect to the subject, to thereby immunize the subject against the pathogen.

Another aspect of the invention provides a method of treating or preventing a disease, disorder, or condition in a subject, the method including the step of administering an effective amount of an isolated chimeric insect-specific flavivirus or pharmaceutical composition comprising the same as described herein to the subject, to thereby treat or prevent the disease, disorder or condition in the subject.

Preferably, the disease, disorder, or condition according to these aspects is associated with a viral infection. Suitably, in these embodiments, the immunogenic sequence of the isolated protein or chimeric insect-specific flavivirus is of or derived from the virus with which the disease, disorder, or condition is associated.

Preferably, the disease, disorder, or condition is associated with a viral infection. Preferably, the viral infection is a flaviviral infection. Preferably, the flaviviral infection is an infection with a virus selected from the group consisting of ZIKV; WNV; Dengue; JEV; YFV; TBEV, SLEV, MVEV; Duck tembusu virus; TMEV; Usutu virus; Sepik virus; Wesselsbron virus; BYD; and SV. In a particularly preferred embodiment, said virus is selected from the group consisting of West Nile virus; Zika virus; and Dengue virus.

In particularly preferred embodiments said virus is selected from the group consisting of Zika virus; West Nile Virus; and Dengue virus. Preferably, the West Nile virus is KUNV. Preferably, the Dengue virus is DENV2.

It will be appreciated that the pharmaceutical composition and/or methods of these aspects may be effective against a plurality of different pathogens and/or effective in treating a plurality of different diseases, disorders or conditions as described above.

Accordingly, as hereinabove described, in some embodiments the isolated protein may comprise one or more additional immunogenic amino acid sequences from one or more other viruses, bacteria, protozoa, worms or other pathogens. Typically, the one or more additional immunogenic amino acid sequences would be relatively short peptide epitopes (e.g 6-20 amino acids) fused to:

(i) the amino acid sequence of a protein encoded by the genome of an insect-specific flavivirus; and/or (ii) the immunogenic amino acid sequence not encoded by the genome of an insect-specific flavivirus;

that do not inhibit or compromise the ability of the isolated protein to form a virus particle.

Any safe route of administration may be employed according to these aspects for providing a subject with the isolated protein, chimeric insect-specific flavivirus, or pharmaceutical composition. For example, enteral, oral, rectal, parenteral, sublingual, buccal, intravenous, intra-articular, intra-muscular, intra-dermal, subcutaneous, inhalational, intraocular, intraperitoneal, intracerebroventricular, transdermal and the like may be employed.

The isolated protein, chimeiric insect-specific flavivirus or pharmaceutical composition according to these aspects may be administered in a manner compatible with the dosage formulation, and in such amount as is pharmaceutically effective. The dose administered to a patient, in the context of the present invention, should be sufficient to effect a beneficial response in a patient over an appropriate period of time. The quantity of agent(s) to be administered may depend on the subject to be treated inclusive of the age, sex, weight and general health condition thereof, factors that will depend on the judgement of the practitioner.

It will also be appreciated that treatment methods and pharmaceutical compositions may be applicable to prophylactic or therapeutic treatment of a subject that is an animal, inclusive of humans and non-human mammals such as livestock (e.g. horses, cattle and sheep, crocodiles, ducks, chickens, turkeys), companion animals (e.g. dogs and cats), laboratory animals (e.g. mice, rats and guinea pigs) and performance animals (e.g. racehorses, greyhounds and camels), although without limitation thereto. In one preferred embodiment, the subject is a human. In another preferred embodiment, the subject is a crocodile.

A related aspect of the invention provides a method of producing an antibody with at least partial specificity against an immunogenic sequence in a subject, the method including the step of administering an isolated chimeric insect-specific flavivirus or pharmaceutical composition comprising the same as described herein to a subject, wherein an antibody is produced in the subject against the immunogenic sequence of the isolated chimeric insect-specific flavivirus, to thereby produce the antibody in the subject.

Suitably, the antibody may be extracted, purified, and/or isolated from the subject after production.

It will be appreciated that the directly preceding aspect may have application in the production of antibodies for research or diagnostic purposes. Without limitation, the subject may be any suitable animal subject for producing antibodies, such as a chicken, goat, guinea pig, hamster, horse, mouse, rat, sheep, or rabbit, as are well known in the art.

Methods for Detecting, Identifying or Screening for Antibodies

The invention also provides detection or diagnosis of antibodies that bind to the immunogenic sequence of the isolated protein or chimeric insect-specific flavivirus.

Accordingly, yet a further aspect of the invention provides a method of detecting, identifying or screening for an antibody in a sample, the method including the steps of combining the diagnostic composition of the thirteenth aspect with a sample, wherein binding of an antibody in the sample to an immunogenic amino acid sequence of the isolated protein or isolated chimeric insect-specific flavivirus of the diagnostic composition facilitates detecting, identifying or screening for the antibody in the sample.

Generally, the term "antibody" includes any product of the immunoglobulin gene complex, inclusive of antibody fragments.

The method according to this aspect may be an in vitro method or an in vivo method.

In the particular context of an in vivo method according to this aspect, a "sample" will be understood to be present in, or a component or part of the subject, whereby the diagnostic composition is administered to the subject and the antibody is detected in situ. For a non-limiting review of in vivo diagnostics, the skilled person is directed to Freise and Wu (2015) *Molecular Immunology*, 67(2A), 142-152, incorporated herein by reference.

In embodiments where the method is an in vitro method, suitably the sample is obtained or obtainable from a subject. The sample may be a fluid sample, a cell sample, a tissue sample, a secretion, waste product or any other sample obtained or obtainable from a subject. By way of example, samples may include urine, whole blood, plasma, serum, cerebrospinal fluid, tears, perspiration, smears, skin punches, swabs, biopsies, hair, faeces, semen and sputum, although without limitation thereto.

In certain preferred embodiments wherein the method of this aspect is an in vitro method, detection of the antibody is performed using an enzyme-linked immunosorbent assay (ELISA) comprising the isolated protein, chimeric insect-specific flavivirus, or composition of the preceding aspects. The ELISA may be a direct ELISA or an indirect ELISA. Reference in regard to ELISA assays is provided in Crowther, supra.

In certain preferred embodiment wherein the method of this aspect is an in vitro method, detection of the antibody is performed using a lateral flow immunoassay.

Preferably, the antibody of this aspect is produced in response to a viral infection. Suitably, in these embodiments, an immunogenic sequence of the isolated insect-specific flavivirus or virus particle is of or derived from the virus with which the disease, disorder, or condition is associated.

Preferably, the viral infection is selected from the group consisting of ZIKV; WNV; Dengue; JEV; YFV; TBEV, SLEV, MVEV; Duck tembusu virus; TMEV; Usutu virus; Sepik virus; Wesselsbron virus; BYD; and SV.

In particularly preferred embodiments said virus is selected from the group consisting of Zika virus; West Nile Virus; and Dengue virus. Preferably, the West Nile virus is KUNV. Preferably, the Dengue virus is DENV2.

Also within the scope of this aspect are methods of screening for a plurality of antibodies, wherein the plurality of antibodies bind to a respective plurality of immunogenic sequences of the isolated protein or chimeric insect-specific flavivirus.

EXAMPLES

Example 1. Materials and Methods

Cell Culture

C6/36 (*Aedes albopictus*) cells were cultured at 28° C. in RPMI 1640 medium supplemented with 5% foetal bovine serum (FBS), respectively. Wild-type (WT) and interferon-α/β receptor deficient (IFNAR$^{-/-}$) mouse embryonic fibroblasts (MEF) were cultured in Dulbecco's modified Eagle's medium (DMEM) supplemented with 5% FBS and grown at 37° C. with 5% $CO_2$. All media contained 50 U penicillin/mL, 50 mg streptomycin/mL and 2 mM L-glutamine Virus Culture PaRV (NC_027817.1), PCV (KC505248.1), BinJV (SEQ ID NO:40), LiCV (SEQ ID NO:386), BgV (SEQ ID NO:41), and WNV$_{KUN}$ (AY274504) viral stocks were propagated in C6/36 cells incubated at 28° C. for 5-7 days. Viral titres were assessed by infection of C6/36 cells with 10-fold serial dilutions of supernatant in 96-well plates and incubation for 5 days. The cell supernatant was aspirated and the monolayers fixed with acetone fixative buffer (20% acetone, 0.02% bovine serum albumin (BSA) in phosphate buffered saline (PBS)). PaRV was detected by enzyme-linked immunosorbent assay (ELISA) using the PaRV-specific monoclonal antibody (mAb) 7D11, whereas WNV$_{KUN}$ was detected using 4G2 [1]. Virus titres were calculated as 50% tissue culture infective dose (TCID$_{50}$) using the methods previously described by Reed and Muench [2].

Preparation of Monoclonal Antibodies to PaRV

All animal procedures had received prior approval from The University of Queensland Animal Ethics Committee (AEC #SCMB/329/15/ARC) and where necessary were performed under ketamine:xylazil anaesthesia. Six-week old BALB/c mice (Animal Resources Centre, Murdoch, Western Australia, Australia) were immunised twice via the subcutaneous route with purified PaRV virions, along with inulin-based adjuvant Advax (Vaxine Ltd, Adelaide, Australia). Mice were kept on clean bedding and given food and water ad libitum. The mouse was boosted with PaRV virions four days prior to harvesting of the spleen. Fusion of the spleen cells with NS0 myeloma cells was performed as previously described [3]. Hybridomas secreting antibodies reactive to PaRV-infected C6/36 cells were identified by ELISA using previously described methods [4]. The target protein of each mAb was determined using PaRV-infected cell lysates in Western blot using previously published methods [4].

Generation and Characterisation of a Modified OpIE2 Insect Promoter

OpIE2 promoter sequences characterised by Blissard and Rohrmann [5] were synthesised as gBlocks Gene Fragments (IDT). These fragments were cloned into a previously generated plasmid containing a sequence which, when expressed by itself, linked the UTR regions of the viral genome together [6]. A Gibson Assembly Master Mix (NEB) was used. Constructs were transformed into DH5c competent E. coli, and colony PCR using Taq DNA Polymerase (NEB) conducted to screen for viable colonies. Plasmids were extracted from overnight cultures of positive colonies using a NucleoSpin Plasmid Miniprep kit (Macherey-Nagel). Extracted plasmids were then sent for sequencing at the Australian Genome Research Centre.

Generation of Viruses by CPEC

CPEC constructs were generated based on previously described methods [6]. Briefly, viral RNA was extracted using a NucleoSpin RNA Virus kit (Macherey-Nagel) and converted to cDNA using a qScript cDNA SuperMix (Quantabio). For each CPEC assembly, 0.1 pmol of each viral cDNA fragment was added to a Q5 PCR reaction (NEB) as per the manufacturer's instructions. Thermal cycling was carried out at 98° C. for 2 mins (one cycle), 98° C. for 30 secs, 55° C. for 30 secs, 72° C. for 6 mins (2 cycles), 98° C. for 30 secs, 55° C. for 30 secs, 72° C. for 8 mins (ten cycles). The entire CPEC reaction was transfected into cells and the passage 0 (P$_0$) cell culture supernatants harvested and stored at −80° C., five days post-transfection.

Growth Kinetics

C6/36 cells seeded at a density of 1×10$^5$ were inoculated in triplicate with a P$_1$ CPEC-derived and P7 wild-type virus stock at a multiplicity of infection (MOI) of 0.1. After incubation at 28° C. for 1 hr the inoculum was removed and the monolayer washed three times with sterile PBS before re-incubating at 28° C. with fresh RPMI 1640 with 2% FBS. Supernatant was harvested at 2 hrs, 24 hrs, 48 hrs, 72 hrs, 96 hrs and 120 hrs. Viral titres from each time point were determined using a TCID$_{50}$ assay as previously described. A two way-ANOVA was performed on the results using Graphpad Prism.

IFA

Cells seeded at a density of 1×10$^5$ on glass coverslips in a 24-well plate were transfected or infected as required. Following a 72 hr incubation, the coverslips were fixed with ice cold 100% acetone and air dried before storing at −20° C. Prior to staining, coverslips were blocked with blocking buffer (0.05 M Tris/HCl (pH 8.0), 1 mM EDTA, 0.15 M NaCl, 0.05% (v/v) Tween-20, 0.2% w/v casein) for 1 hr at room temperature. Coverslips were then incubated for 1 hr with primary antibody in blocking buffer. Following 3 washes with PBS containing 0.05% Tween-20 (PBST), secondary staining was carried out with Alexafluor 488-conjugated goat anti-mouse IgG (H+L) (Invitrogen) diluted 1:1000 in blocking buffer for 1 hr. A Hoechst 33342 nuclear stain (Invitrogen) was applied for 5 mins at room temperature. Following a final 3 washes with PBST, the coverslips were mounted onto glass microscope slides using ProLong Gold Anti-fade (Invitrogen). All coverslips were viewed under the ZEISS LSM 510 META confocal microscope.

Cell Transfection

C6/36 cells were transfected with DNA using Effectene (Qiagen) or RNA using TransMessenger (Qiagen), as per the manufacturer's instructions. Wild-type and IFNAR$^{-/-}$ MEF cells were transfected using Lipofectamine LTX (Invitrogen), as per the manufacturer's instructions.

Example 2. CPEC Insect Promoter Optimisation

Figure 5:
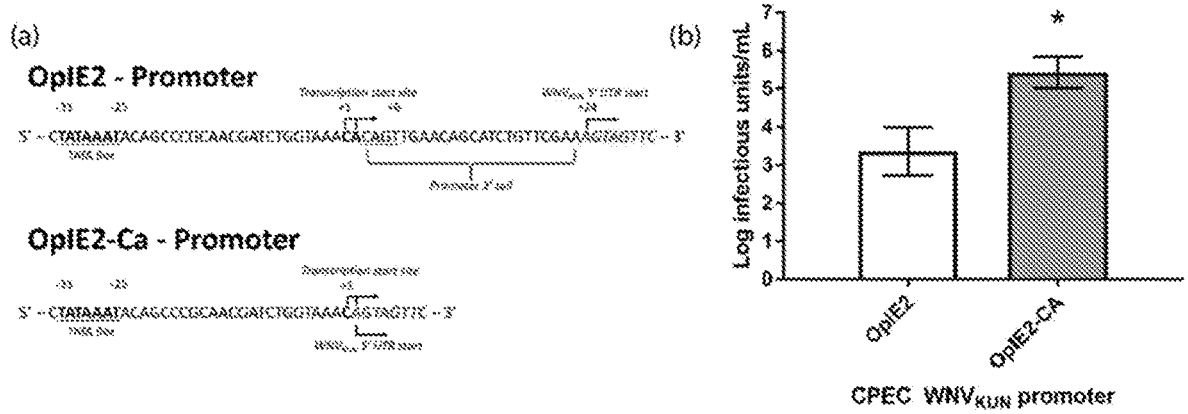
FIG. 5 illustrates OpIE2 promoter optimisation. (a) Schematic of the 3' termini of the OpIE2 (SEQ ID NO:15) and OpIE2-CA (SEQ ID NO:16) promoters; (b) $TCID_{50}$ of $P_0$ supernatants from C6/36 cells transfected with $WNV_{KUN}$ CPEC containing either the OpIE2 or OpIE2-CA promoter (n=3 biological replicates for each construct). Supernatants harvested 5 days post-transfection indicate that the OpIE2-CA promoter yields approximately 100-fold higher titres than the OpIE2 promoter. Error bars represent standard deviation and asterisks indicate significance (P value>0.05; two-tailed t-test).
Figure 6:
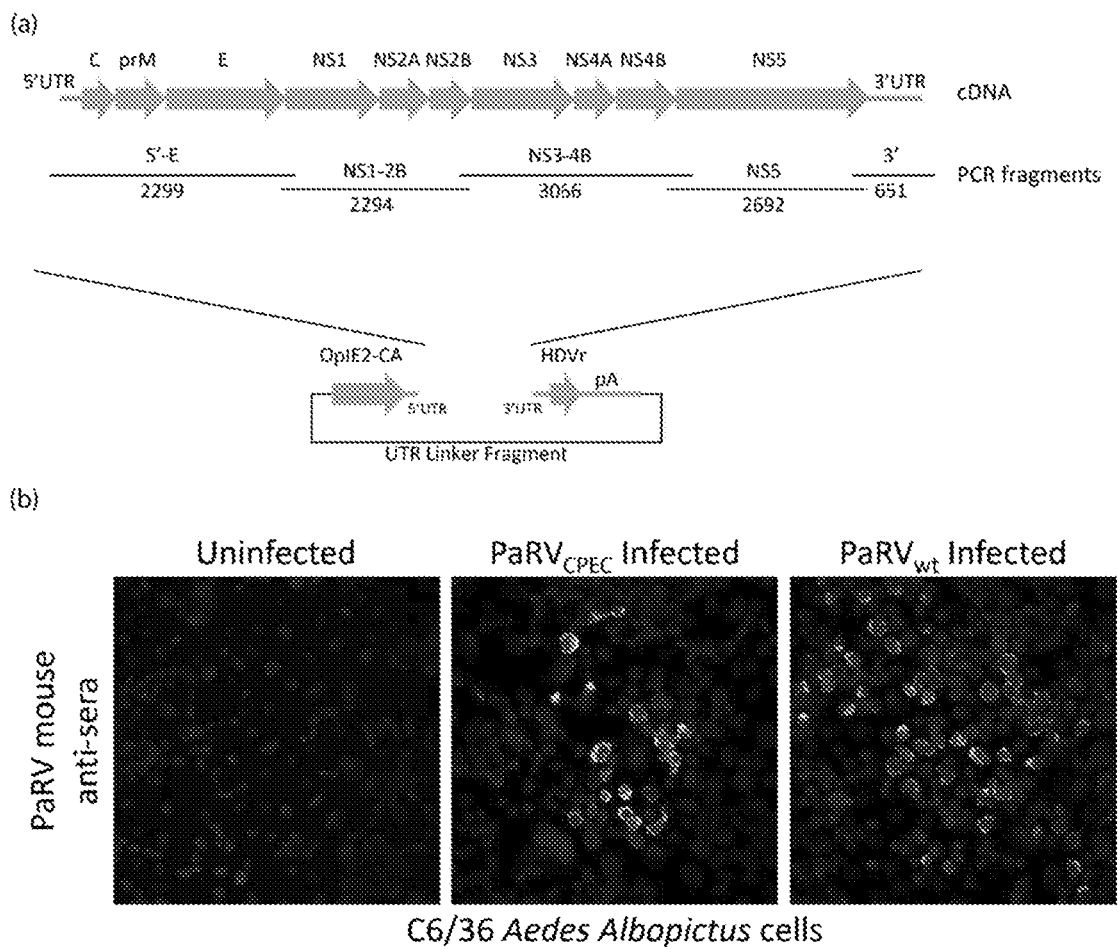
FIG. 6 illustrates generation of PaRV using CPEC. (a) A schematic representation for the assembly of infectious DNA for PaRV by CPEC reaction; (b) Visualisation of PaRV replication in mosquito (C6/36) cell monolayers inoculated with either an MOI of 0.1 $PaRV_{WT}$ or undiluted $P_0$ $PaRV_{CPEC}$. Monolayers were fixed 72 hrs post-infection. IFA analysis was performed by probing with PaRV mouse anti-sera. The nucleus of each cell was stained with Hoechst 33342. Images were taken at ×40 magnification.
Figure 7:
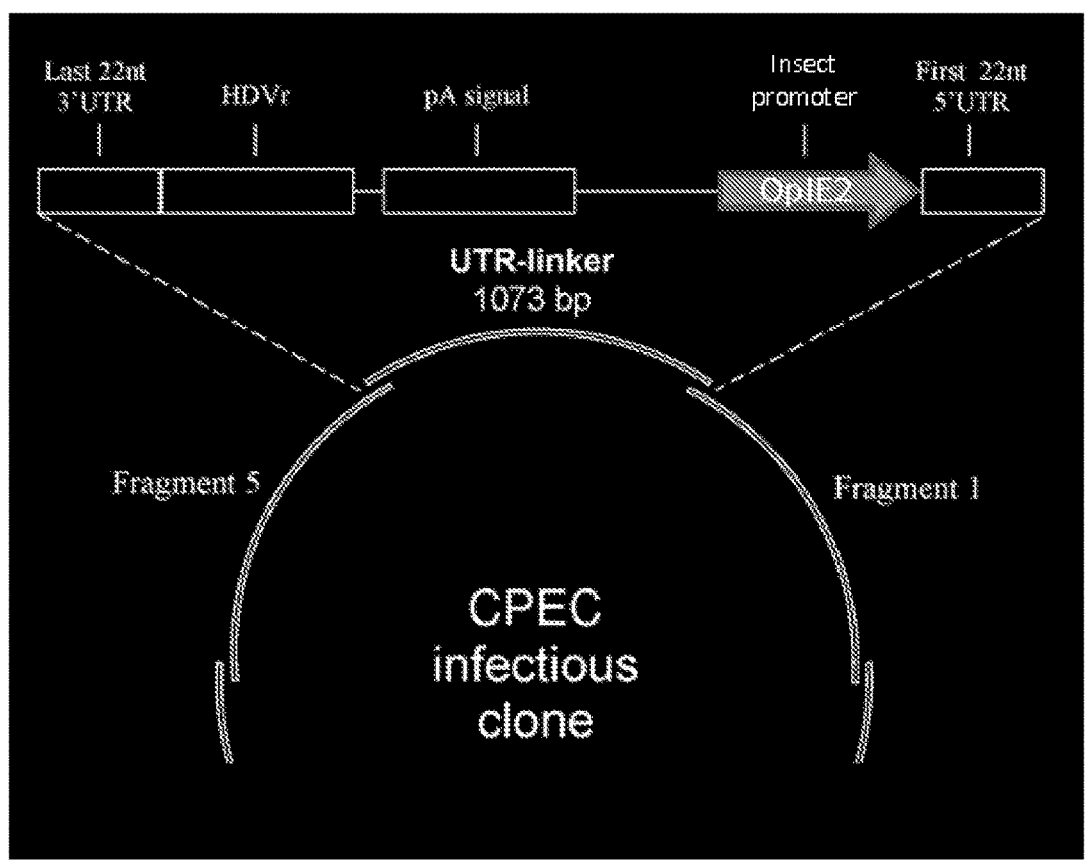
FIG. 7 illustrates components of a nucleic acid comprising an insect-specific promoter (OpIE2) used for generation of a preferred vector of the invention by CPEC.

The OpIE2 promoter originally described by Blissard and Rohrmann [5] was chosen to attempt to drive transcription of CPEC-assembled infectious cDNA in insect cells. The UTR-linker fragment as described in [6] was modified to replace the existing CMV promoter with either the complete OpIE2 promoter (SEQ ID NO:15) or a truncated version lacking the 23 nucleotides comprising the promoter 3' tail downstream of the transcription start site (OpIE2-CA; SEQ ID NO:16) (FIG. 5). The modified OpIE2 UTR-linker was assembled by CPEC with cDNA fragments from WNV$_{KUN}$ and directly transfected into C6/36 cells. A TCID$_{50}$ of recovered infectious virus following transfection of WNV$_{KUN}$ CPEC constructs into C6/36 cells indicated that passage 0 (P$_0$) titres were approximately 100-fold higher when using the OpIE2-CA (10$^{5.42}$ IU/mL) rather than the OpIE2 ($10^{3.35}$ IU/mL) promoter (FIG. 5).

Example 3. Generation of Flavivirus DNA Constructs Using Circular Polymerase Extension Cloning The modified OpIE2-CA UTR-linker fragment was selected for generating a vector driving PaRV infectious cDNA, by CPEC, set forth SEQ ID NO:37 (see the schematic in FIG. 6). Primers used for constructing the PaRV CPEC vector were designed to anneal at the junctions between viral genes (FIG. 6; Table 1). CPEC-derived PaRV ($PaRV_{CPEC}$) was successfully recovered from two independent transfection experiments into C6/36 cells, and the authenticity of the virus confirmed by sequencing upstream of the E protein. $P_0$ $PaRV_{CPEC}$ supernatant was re-inoculated on to fresh C6/36 cells, and detected using anti-PaRV mouse serum [7] in IFA 3 days post-transfection to show successful replication of live $PaRV_{CPEC}$ (FIG. 6).

Similarly, CPEC vectors designed to drive infectious BgV (SEQ ID NO:34); BinJV (SEQ ID NO:35); and PCV (SEQ ID NO:36) were produced. The primers for producing these respective vectors using CPEC are set forth in Table 1.

Figure 3:
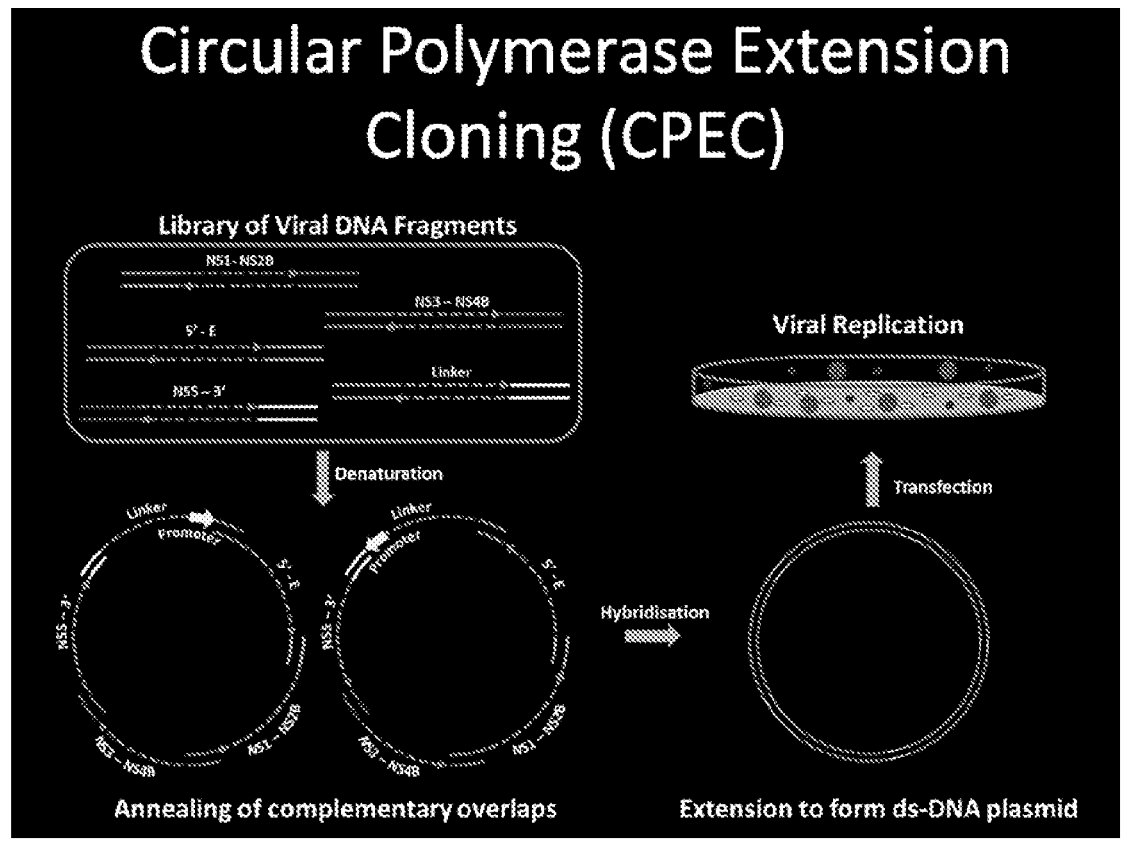
FIG. 3 provides a schematic of the generation of vectors of the invention using Circular Polymerase Extension Cloning (CPEC) and generation of insect-specific flaviviruses therefrom.
Figure 4:
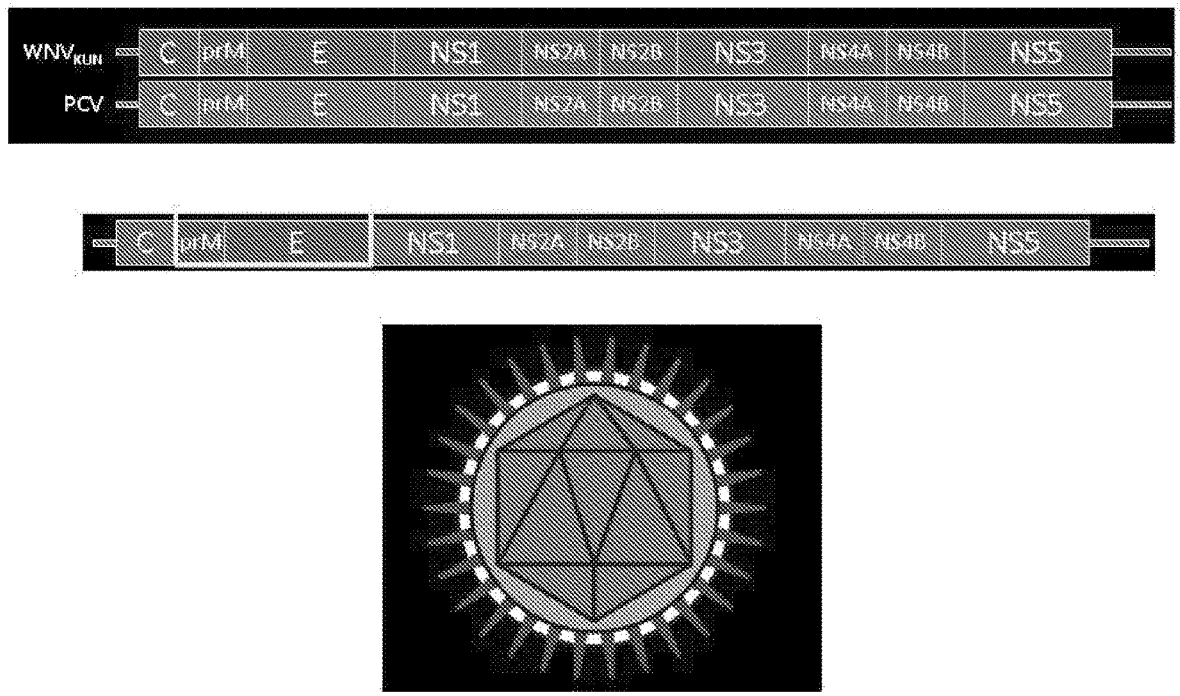
FIG. 4 illustrates the structure of a preferred insect-specific flavivirus of the invention, wherein the insect-specific flavivirus comprises amino acid sequence of a first insect-specific flavivirus (Capsid and NS1, NS2A, NS2B, NS3, NS4A, NS4B, and NS5 amino acid sequence from Palm Creek virus) and an immunogenic sequence of a second flavivirus (prM and Envelope amino acid sequence from West Nile virus, KUNV subtype). Native Palm Creek virus and West Nile virus are illustrated for reference (top).
Figure 8:
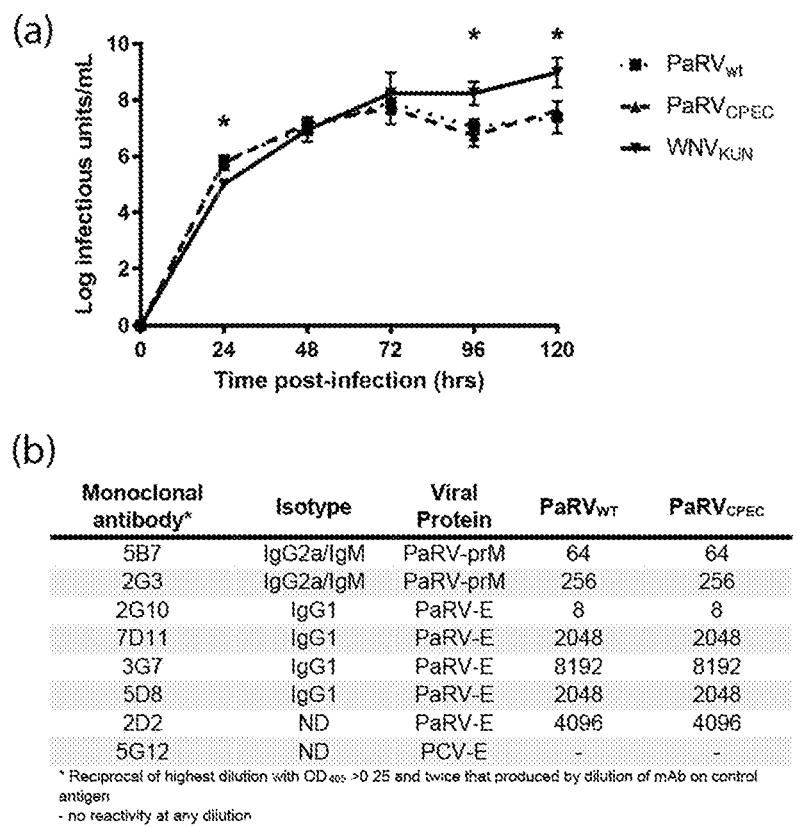
FIG. 8 sets forth results of phenotypic analysis of $PaRV_{WT}$ and $PaRV_{CPEC}$. (a) Comparative growth kinetics of $PaRV_{WT}$, $PaRV_{CPEC}$ and $WNV_{KUN}$ in C6/36 cells. C6/36 cells were infected with either $PaRV_{WT}$, $PaRV_{CPEC}$ or $WNV_{KUN}$ at an MOI of 0.1. Infectious titres at each time point were determined by titration of culture supernatant on to fresh C6/36 cells with infection detected using fixed cell ELISA. Error bars represent standard deviation and asterisks indicate significance (P value>0.001) as determined by a two-way ANOVA. (b) Comparison of reciprocal titres for the reactivity of a panel of anti-PaRV (5B7, 2G3, 2G10, 7D11, 3G7, 5D8, 2D2 and 1E5) and anti-PCV control (5G12) mAbs to $PaRV_{WT}$ and $PaRV_{CPEC}$.

Example 4. CPEC-Derived Viruses are Phenotypically the Same as Wild Type Viruses PaRV$_{CPEC}$ was assessed by two methods to confirm that it was phenotypically the same as PaRV$_{WT}$. In a growth kinetics assay, PaRV$_{CPEC}$ displayed an identical growth profile to PaRV$_{WT}$, with no significant difference in the titres at any time point (two-way ANOVA). PaRV$_{CPEC}$ and PaRV$_{WT}$ replicated rapidly in the first 24 hrs (PaRV$_{CPEC}$ $10^{5.78}$/mL; PaRV$_{WT}$ $10^{5.86}$/mL), reaching a peak titre at 72 hrs (PaRV$_{CPEC}$ $10^{7.72}$/mL; PaRV$_{WT}$ $10^{7.91}$/mL), after which the virus titre plateaued (FIG. 3a). Consistent with a previous study [7], the titre of PaRV at 24 hours was significantly higher than WNV$_{KUN}$, however at four days post-infection WNV$_{KUN}$ ($10^{5.86}$/mL) produced a significantly (two-way ANOVA; P<0.001) higher titre of virus than both PaRV$_{WT}$ ($10^{7.39}$/mL) and PaRV$_{CPEC}$ ($10^{7.63}$/mL). Further antigenic analysis using a panel of monoclonal antibodies, that were reactive to PaRV prM or E proteins, similarly confirmed the antigenic conservation between of PaRV$_{WT}$ and PaRV$_{CPEC}$ (FIG. 8). Comparison of infectious virus derived from P0 transfections of either PaRV RNA or a PaRV CPEC reaction revealed relatively comparable titres of $10^{7.80}$/mL and $10^{6.97}$/mL, respectively after a 5 day incubation.

Similar assessment was conducted for PCV$_{CPEC}$. The growth kinetics of this virus are set forth in FIG. 5B; with a peak titre of $10^{7.5}$/ml observed at 48 hours. Furthermore, antigenic authenticity of the virus was confirmed using monoclonal antibodies, and nucleotide sequence was confirmed by sequencing.

Growth kinetics of BgV$_{CPEC}$ and BinJV$_{CPEC}$ were also assessed, with peak titres of $10^{7}$/ml and $10^{8.4}$/ml observed, respectively.

Figure 9:
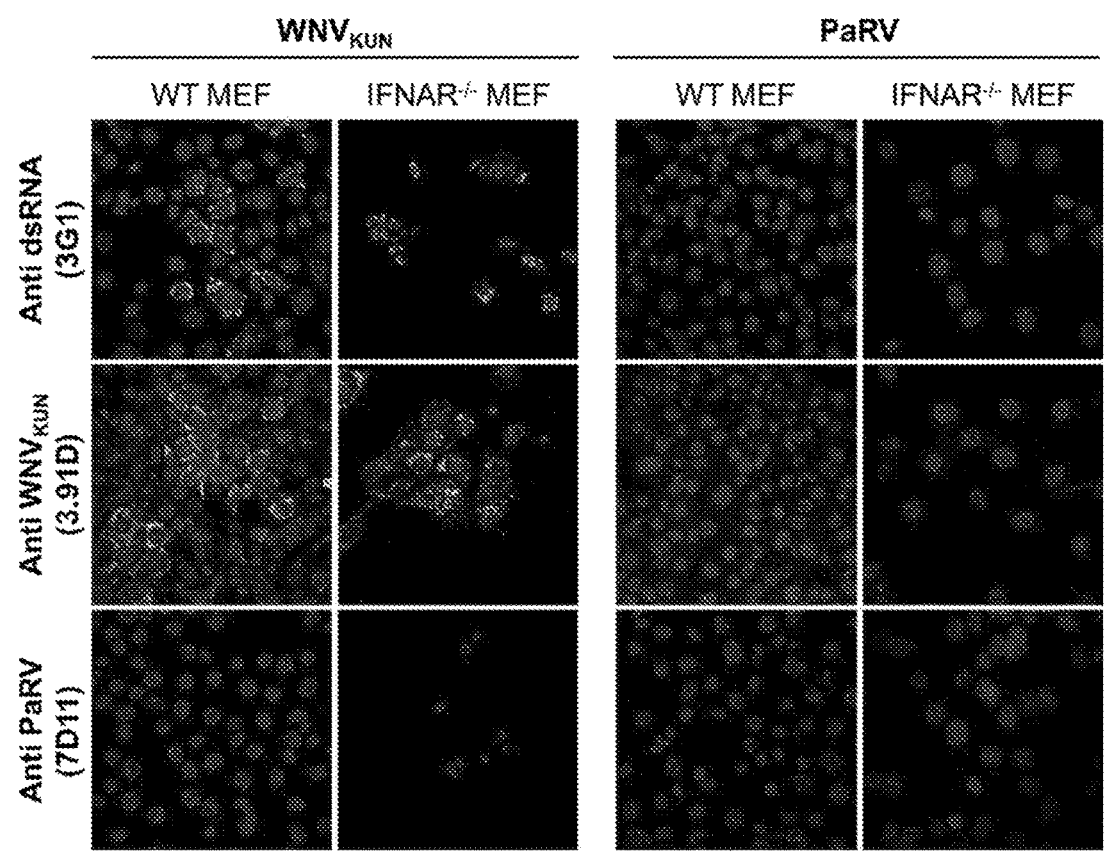

Example 5. Using CPEC to Bypass Viral Entry does not Overcome Host Restriction of PaRV in Either IFN Response-Competent or -Deficient Cells There is recent evidence that the *Aedes*-associated ISF, Kamiti River virus, can enter and replicate in vertebrate cells in vitro in the absence of interferon regulatory factors [8]. We examined whether PaRV, another *Aedes*-associated ISF, could also replicate in IFN response-deficient (IFN-α/β receptor knockout, IFNAR$^{-/-}$) mouse embryonic fibroblasts via inoculation with PaRV, or by bypassing viral entry through transfecting with a PaRV CPEC vector driven by a CMV promoter. An IFA of inoculated MEF cells showed that there was no observable replication of PaRV in either the WT or IFNAR$^{-/-}$ MEFs (FIG. 9). In contrast, WNV$_{KUN}$ replicated readily. A TCID$_{50}$ conducted on the supernatant from CPEC-transfected MEF cells indicated that no infectious PaRV was produced from either cell line, while titres of 8.5×10$^4$ IU/mL and 3.5×10$^6$ IU/mL were observed for WNV$_{KUN}$ transfected WT and IFNAR$^{-/-}$ MEF cells, respectively.

Example 6. Chimeric ISF Vectors not Observed to Replicate Virus

Figure 10:
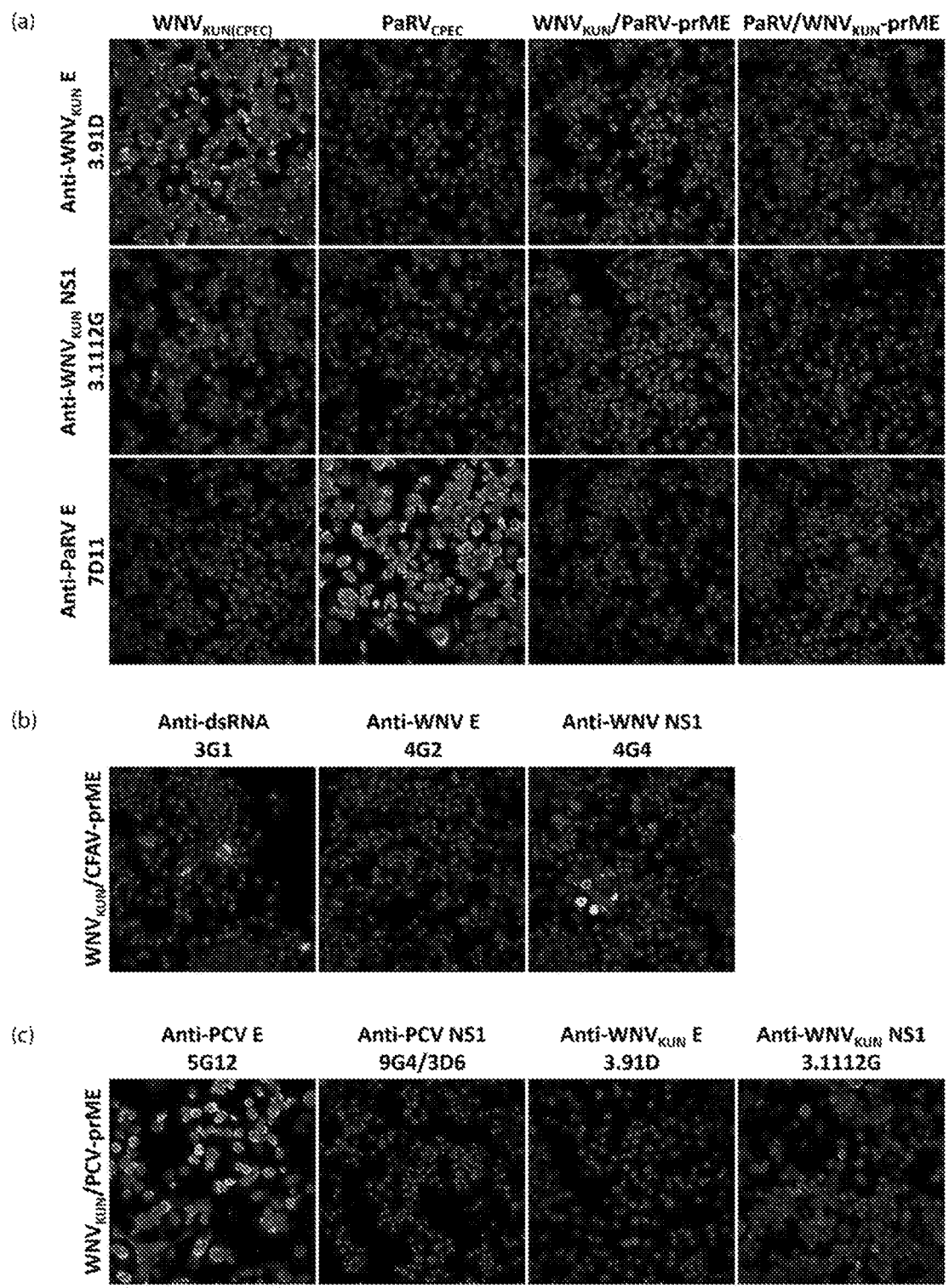
FIG. 10 sets forth replication of chimeric flaviviruses. (a) Visualisation of C6/36 cells transfected with CPEC constructs of either $WNV_{KUN}$, PaRV, $WNV_{KUN}$/PaRV-prME or PaRV/$WNV_{KUN}$-prME chimeras. IFA analysis was performed by probing with anti-PaRV (7D11), anti-$WNV_{KUN}$ E (3.91D) and anti-$WNV_{KUN}$ NS1 (3.1112G) mouse antibodies. (b) Visualisation of C6/36 cells transfected with a chimeric CPEC construct of $WNV_{KUN}$/CFAV-prME. IFA analysis was performed by probing with anti-dsRNA (3G1), anti-WNV E (4G2) and anti-WNV NS1 (4G4) mouse antibodies. (c) Visualisation of C6/36 cells transfected with a chimeric CPEC construct of $WNV_{KUN}$/PCV-prME. IFA analysis was performed by probing with anti-PCV E (5G12), anti-PCV NS1 (9G4/3D6), anti-$WNV_{KUN}$ E (3.91D) and anti-$WNV_{KUN}$ NS1 (3.1112G) mouse antibodies. Monolayers were fixed 5 days post-transfection. The nucleus of each cell was stained with Hoechst 33342. Images were taken at ×40 magnification.

Vectors as described in Example 3, but containing either the PaRV prME genes on a WNV$_{KUN}$ genomic backbone (WNV$_{KUN}$/PaRV-prME; SEQ ID NO:31) or the WNV$_{KUN}$ prME genes on a PaRV genomic backbone (PaRV/WNV$_{KUN}$-prME; SEQ ID NO:385) were designed. CPEC was performed and transfected into C6/36 cells. While replicates of simultaneously transfected WNV$_{KUN}$ and PaRV$_{CPEC}$ control constructs were positive for virus replication as determined by IFA 5 days post-transfection, neither WNV$_{KUN}$/PaRV-prME nor PaRV/WNV$_{KUN}$-prME replication was detected (FIG. 10). Passaging the P$_0$ supernatant of the cells transfected with the chimeric CPEC constructs also failed to show any replication. The results indicated a possible incompatibility of genes between PaRV and WNV$_{KUN}$.

A CPEC vector containing the prME genes from CFAV isolated from Australian *Aedes aegypti* mosquitoes on a WNV$_{KUN}$ genomic backbone (WNV$_{KUN}$/CFAV-prME; SEQ ID NO:27) was also produced. IFA analysis on transfected C6/36 cells indicated limited viral RNA replication and protein expression (FIG. 10), however titration and passaging of P$_0$ supernatant indicated that no infectious virus was being produced.

Example 7. Chimeric WNV/PCV Vector Capable of Replicating Virus

A further CPEC vector containing the prME genes of another Australian ISF, Palm Creek virus (PCV) [9], on a WNV$_{KUN}$ genomic backbone (WNV$_{KUN}$/PCV-prME; SEQ ID NO:20) was also produced.

The WNV$_{KUN}$/PCV-prME vector successfully generated viable virus when transfected in C6/36 cells. IFA analysis of the chimeric WNV$_{KUN}$/PCV-prME virus revealed the detection of both the PCV E protein and WNV$_{KUN}$ NS1 protein, but not the expression of PCV NS1 or WNV$_{KUN}$ E proteins (FIG. 10), indicating that the correct chimeric virus was made. The authenticity of the WNV$_{KUN}$/PCV-prME chimera was further verified by sequencing the viral RNA isolated from passaged P$_1$ C6/36 supernatant.

Example 8. Chimeric ISF Vectors

Guided by the results set forth in Example 7, preferred chimeric ISF vectors suitable for production using CPEC have been designed and tested, and also found to be capable of replicating virus:

PCV/WNV$_{KUN}$-prME (SEQ ID NO:11)
PCV/ZIKA-prME (SEQ ID NO:12);
PCV/DENV2-prME (SEQ ID NO:13);
BgV/WNV$_{KUN}$-prME (SEQ ID NO:14);
BinJV/WNV$_{KUN}$-prME (SEQ ID NO:388);
BinJV/ZIKV-prME (SEQ ID NO:390);
BinJV/DENV1-prME (SEQ ID NO:394);
PaRV/KRBV-prM (SEQ ID NO:398)

Primers used to produce a subset of the above vectors by CPEC are set forth in Table 1.

These chimeric ISF vectors were designed to replicate chimeric ISFs comprising immunogenic sequences in the form of prME or prM proteins encoded by the genome of a flaviviruse that is not insect-specific; and C and NS1-NS5 proteins encoded by the genome of an insect-specific flavivirus that is capable of infecting a plurality of types of insect cells.

By way of example, detail regarding the structural features of a subset of the above vectors is provided below. Similar information will be readily determinable for the remaining vectors by the skilled person, using standard bioinformatics tools in combination with the flavivirus sequences used for the chimeric ISF vectors, and the examples provided herein.

PCV/WNV$_{KUN}$-prME

PCV/WNV$_{KUN}$-prME vector is designed to replicate a chimeric ISF containing prME from WNV, and the remaining flavivirus proteins (C and NS1-NS5) from PCV. Nucleotide sequence of the vector is set forth in SEQ ID NO:11, with reference to FIG. 22. Key features of the vector are as follows:

OpIE2-CA promoter: nucleotides 427-958
5'UTR from PCV: nucleotides 959-1056
Region encoding C protein from PCV: nucleotides 1057-1464
Region encoding prM protein from KUNV: nucleotides 1465-1965
Region encoding E protein from KUNV: nucleotides 1966-3468
Region encoding NS1 protein from PCV: nucleotides 3469-4624
Region encoding NS2A protein from PCV: nucleotides 4625-5352
Region encoding NS2B protein from PCV: nucleotides 5353-5733
Region encoding NS3 protein from PCV: nucleotides 5734-7494
Region encoding NS4A protein from PCV: nucleotides 7495-8010
Region encoding NS4B protein from PCV: nucleotides 8011-8769
Region encoding NS5 protein from PCV: nucleotides 8770-11436
3'UTR from PCV: nucleotides 11437-11978
When transfected in C6/36 cells, this vector produced chimeric insect-specific flavivirus at a titre of $1.7 \times 10^6$/ml.

PCV/ZIKA-prME

PCV/ZIKA-prME vector is designed to replicate a chimeric ISF containing prME from ZIKA, and the remaining flavivirus proteins (C and NS1-NS5) from PCV. Nucleotide sequence of the vector is set forth in SEQ ID NO:12, with reference to FIG. 23. Key features of the vector are as follows:

OpIE2-CA promoter: nucleotides 427-958
5'UTR from PCV: nucleotides 959-1056
Region encoding C protein from PCV: nucleotides 1057-1464
Region encoding prM protein from ZIKA: nucleotides 1465-1968
Region encoding E protein from ZIKA: nucleotides 1969-3480
Region encoding NS1 protein from PCV: nucleotides 3481-4636
Region encoding NS2A protein from PCV: nucleotides 4637-5364
Region encoding NS2B protein from PCV: nucleotides 5365-5745
Region encoding NS3 protein from PCV: nucleotides 5746-7506
Region encoding NS4A protein from PCV: nucleotides 7507-8022
Region encoding NS4B protein from PCV: nucleotides 8023-8781
Region encoding NS5 protein from PCV: nucleotides 8782-11448
3'UTR from PCV: nucleotides 11449-11990
When transfected in C6/36 cells, this vector produced chimeric insect specific flavivirus at a titre of $3.9 \times 10^7$/ml.

PCV/DENV2-prME

PCV/DENV2-prME vector is designed to replicate a chimeric ISF containing prME from DENV2, and the remaining flavivirus proteins (C and NS1-NS5) from PCV. Nucleotide sequence of the vector is set forth in SEQ ID NO:13, with reference to FIG. 24. Key features of the vector are as follows:

OpIE2-CA promoter: nucleotides 427-958
5'UTR from PCV: nucleotides 959-1056
Region encoding C protein from PCV: nucleotides 1057-1464
Region encoding prM protein from DENV2: nucleotides 1465-1962
Region encoding E protein from DENV2: nucleotides 1963-3447
Region encoding NS1 protein from PCV: nucleotides 3448-4603
Region encoding NS2A protein from PCV: nucleotides 4604-5331
Region encoding NS2B protein from PCV: nucleotides 5332-5712
Region encoding NS3 protein from PCV: nucleotides 5713-7473
Region encoding NS4A protein from PCV: nucleotides 7474-7989
Region encoding NS4B protein from PCV: nucleotides 7990-8748
Region encoding NS5 protein from PCV: nucleotides 8749-11415
3'UTR from PCV: nucleotides 11416-11957
When transfected in C6/36 cells, this vector produced chimeric insect-specific flavivirus at a titre of $3.6 \times 10^5$/ml.

BgV/WNV$_{KUN}$-prME

BgV/WNV$_{KUN}$-prME vector is designed to replicate a chimeric ISF containing prME from KUNV, and the remaining flavivirus proteins (C and NS1-NS5) from BgV. Nucleotide sequence of the vector is set forth in SEQ ID NO:14, with reference to FIG. 25. Key features of the vector are as follows:

OpIE2-CA promoter: nucleotides 427-958
5'UTR from BgV: nucleotides 959-1074
Region encoding C protein from BgV: nucleotides 1075-1416
Region encoding prM protein from KUNV: nucleotides 1417-1917
Region encoding E protein from KUNV: nucleotides 1918-3420
Region encoding NS1 protein from BgV: nucleotides 3421-4476
Region encoding NS2A protein from BgV: nucleotides 4477-5151
Region encoding NS2B protein from BgV: nucleotides 5152-5541
Region encoding NS3 protein from BgV: nucleotides 5542-7407
Region encoding NS4A protein from BgV: nucleotides 7408-7785
Region encoding 2K protein from BgV: nucleotides 7786-7854
Region encoding NS4B protein from BgV: nucleotides 7855-8595
Region encoding NS5 protein from BgV: nucleotides 8596-11310
3'UTR from PCV: nucleotides 11311-11830
When transfected in C6/36 cells, this vector produced chimeric insect-specific flavivirus at a titre of $10^{8.15}$ infectious units/ml.

Example 9. Further Chimeric ISF Vectors

The following further chimeric ISF vectors suitable for production using CPEC were designed:
WNV$_{KUN}$/BgV-prME (SEQ ID NO:23);
WNV$_{KUN}$/BinJV-prME (SEQ ID NO:25); and
WNV$_{KUN}$/KRBV-prME (SEQ ID NO:29).

Primers used to produce the above vectors by CPEC are set forth in Table 1.

These chimeric ISF vectors are designed to replicate chimeric ISFs comprising immunogenic sequences in the form of C and NS1-NS5 proteins encoded by the genome of a flaviviruse that is not insect-specific, and prME proteins encoded by the genome of an insect-specific flavivirus.

The key regions of these respective vectors are similar as set forth in Example 8, and can readily be discerned by the skilled person, e.g. using suitable bioinformatics tools.

Example 10. Increasing the Specificity of Diagnostic Antigens Using ISF-VIF$_{EDIII}$ and ISF—VIF$_{prM}$ Chimeras Diagnosing flavivirus infection is notoriously difficult due to the cross-reactivity of antibodies to the conserved immuno-dominant antigenic epitopes in the fusion loop of domain II of the E protein. This is a substantial issue for serologically differentiating between ZIKV and DENY infections. However, it has been shown that the E protein domain III subunit (EDIII) can confer diagnostic specificity for differentiating antibody responses to closely related flaviviruses such as WNV, Murray Valley encephalitis virus (MVEV), JEV and St Louis encephalitis virus. Furthermore, recent analysis of the human antibody response to Zika or dengue revealed that 90% of EDIII-reactive antibodies are specific to the infecting virus making EDIII a prime candidate for Zika diagnostics. The flavivirus prM protein similarly confers diagnostic specificity and has been shown to differentiate between antibody responses to DENY and JEV and between WNV and MVEV.

Figure 61:
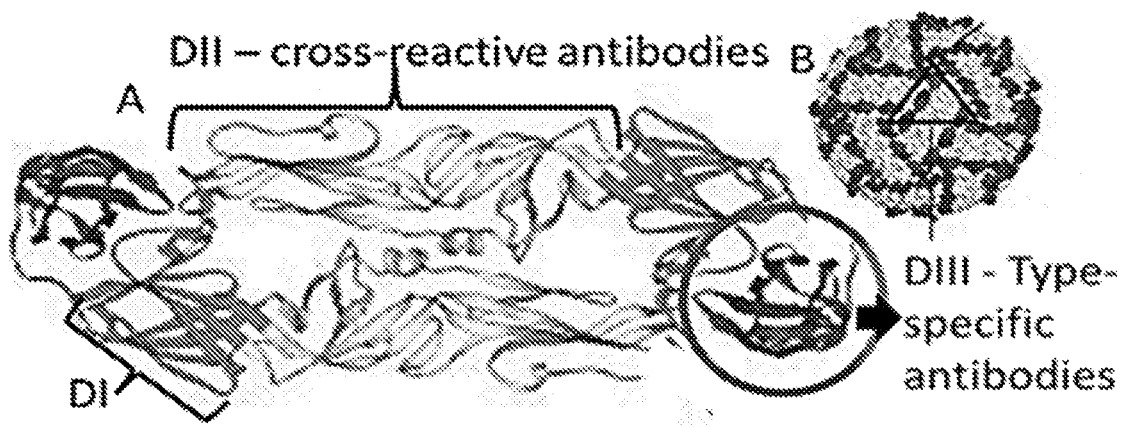
FIG. 61 illustrates the structure of a chimeric E protein comprising an immunogenic EDIII domain. Flavivirus E protein has 3 domains: DI, DII and DIII (A). ISF-VIF EDIII chimeras will produce virions comprising ISF structural proteins, except for VIF EDIII (blue, B).

It has been recognised for this invention that chimeric insect-specific flaviviruses as described herein which feature particular immunogenic E protein domains and/or prM proteins may offer substantial advantages in regard to specificity of antibody binding. In particular, it is considered that chimeric insect-specific flaviviruses wherein the EDIII domain is of or derived from a vertebrate infecting flavivirus (VIF), and the remainder of the E protein is of or derived from an insect-specific flavivirus (see, e.g., FIG. 61), may be particularly desirable in regard to the specificity of responses of antibodies produced against the VIF.

Notably, in experiments conducted for the invention, no cross-reactivity has been observed upon assessment of PCV, PaRV and BinJV proteins with extensive panels of mAbs specific to vertebrate E and prM proteins. This suggests that, where the immunogenic sequence of at least certain preferred isolated proteins or chimeric insect-specific flaviviruses as herein described is of or derived from a VIF that is highly specific for the VIF (e.g. the EDIII domain), the protein or chimeric insect-specific flaviviruses should show overall very high specificity in regard to binding of antibodies targeting the VIF.

Systematic assessment of the use of PCV, PaRV and BinJV E protein scaffolds for the expression of the EDIII domain of the E protein or prM of WNV, DENY and ZIKV E domain- and prM-specific chimeras is therefore to be conducted. Specificity of binding of antibodies to these chimeric proteins of the invention will be assessed using panels of well-characterised immune serum to WNV, DENY or ZIKV from naturally infected humans and animals. To further challenge the specificity of the proteins, immune sera to heterologous flavivirus infections will similarly be assessed, including that from MVEV and JEV virus-infected individuals. Highly specific binding of WNV, DENY, or ZIKV antibodies to the respective isolated proteins is anticipated.

An example of such an isolated protein (BinJV/WNV$_{KUN}$v-EDIII) that is to be assessed, comprising BinJV C, NS1-NS5, and prM amino acid sequence, and chimeric E protein amino acid sequence wherein the EDIII domain is of WNV and the remaining amino acid sequence is of BinJV, is set forth in SEQ ID NO:32. A CPEC vector encoding the BinJV/WNV$_{KUNV}$-EDIII protein is set forth in SEQ ID NO:33. Initial in silico analysis suggests that the BinJV E protein may be a particularly strong candidate for exchange of these regions with WNV, as has been performed in the BinJV/WNV$_{KUNV}$-EDIII protein. This is due to the presence of few deletions within the BinJV E protein amino acid sequence as compared to VIF E proteins, and high overall homology with VIF E proteins.

Isolated chimeric proteins such as BinJV/WNV$_{KUNV}$-EDIII that are confirmed to be bound by corresponding antibodies with high specificity, using the approach set out in this example, will be considered particularly desirable for diagnostic applications as described herein.

Example 11. Lilly Creek Virus

Figure 76:
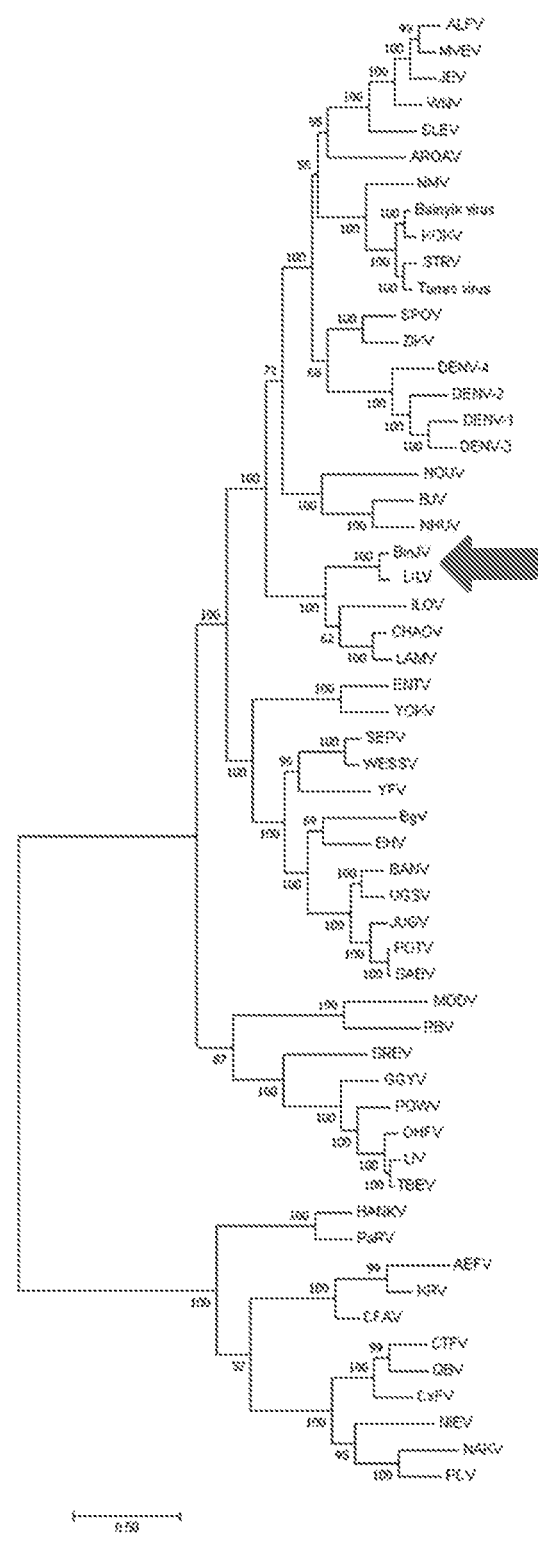

A new virus has been discovered for the purposes of this invention that is related to BinJV, but is a distinct species. The virus has been named 'Lilly Creek virus' (abbreviated herein as LiCV or LLCFV), and shares 90.8% amino acid identity and 76.3% nucleotide identity across the ORF with BinJV (FIG. 74). Phylogenetically, BinJV and LiCV branch together (FIG. 76). Accordingly, LiCV is considered a Lineage II ISF. The genomic sequence of LiCV is set forth in SEQ ID NO:386 (FIG. 62). The amino acid sequence of the ORF of LiCV is set forth in SEQ ID NO:387 (FIG. 63).

It has been determined for the invention that LiCV displays an insect-specific phenotype substantially the same as BinJV, with no replication detected in vertebrate cells (FIG. 77).

Figure 78:
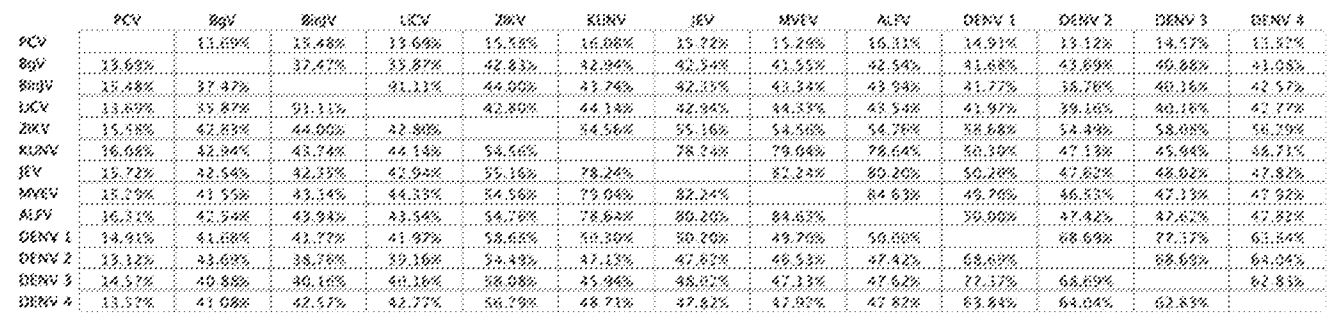

LiCV sequence is considered desirable for the purpose of producing chimeric ISF vectors similar to those herein described. It is noted that, despite overall high similarity, differences in the amino acid sequences between BinJV and LiCV may make one or the other better for chimerisation with VIFs, particularly for the production of envelope protein domain chimeras. As set out in FIG. 78, across the envelope protein, BinJV and LiCV display differences in homology with VIF envelope protein sequences.

Example 12. Growth Kinetics of BinJV and Associated ISF Chimeras

A comparative assessment of growth of BinJV virus and associated chimeric ISF vectors (BinJV/WNV-prME; BinJV/ZIKV-prME, and BinJV/WNV-EDI) with PCV and an associated chimeric ISF vector (PCV/WNV$_{KUN}$-prME) was performed. For this assessment, similar as hereinabove described C6/36 mosquito cell cultures were inoculated with the wild type ISF viruses or chimeric viruses and harvested 5-7 days post-infection. The infectious virus titre of the resulting stock was determined by titration onto mosquito cells.

Figure 79:
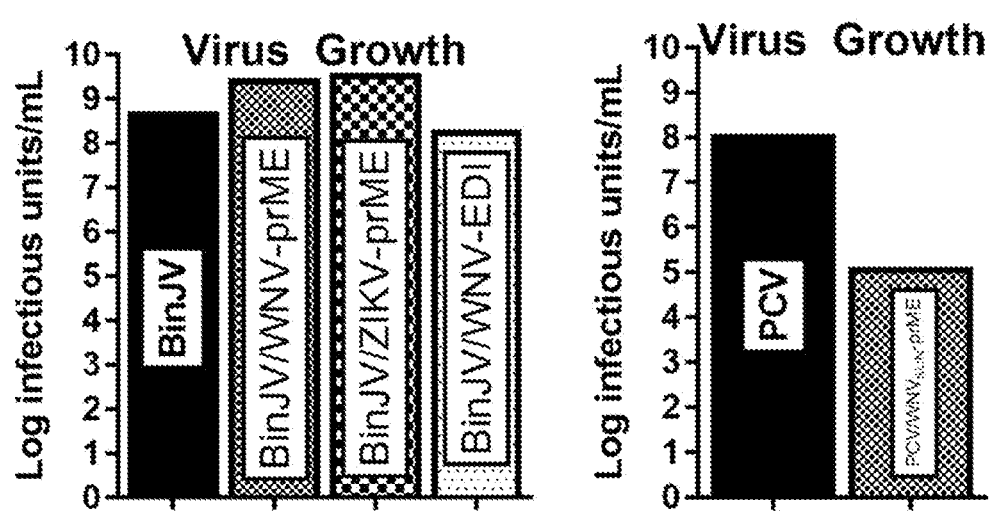

Results are set forth in FIG. 79. The growth of BinJV and associated chimeras was higher than PCV and associated chimeras. It will be appreciated that, in some circumstances BinJV chimeric ISF constructs may be especially preferred for optimal or greater yield of virus particles, although without limitation thereto.

Example 13. Host Restriction Analysis of BinJV

An assessment of the ability of BinJV to infect and replicate in various vertebrate cell lines (including those with defective interferon response: MEF IFNAR$^{-/-}$), and mosquito cell lines (including those of *Culex, Aedes* and *Anopheles* origin) was undertaken. The results are set forth in FIG. 80, and demonstrate that BinJV cannot infect or replicate in vertebrate cells to any substantial extent, but can successfully infect and replicate in a range of mosquito cells.

In view of this data, use of BinJV for chimeric ISF vectors as described herein may be particularly desirable in at least some circumstances, e.g. from a safety perspective such as in the context of diagnostics and/or vaccines, and/or from a flexibility perspective with respect to suitable insect cells for use in replication of the chimeric ISFs.

Example 14. Host Restriction Analysis of Chimeric ISF at Lowered Temperature

In certain cases, viral replication can be restricted in a particular cell at 37° C., but replication can occur at lower temperatures (e.g. 34° C.). To explore this in the context of the chimeric ISFs described herein, assessment of an exemplary chimeric ISF (BinJV/WNV$_{KUN}$-prME) was performed at 37° C. and 34° C. in a range of mammalian cell lines. Wild type BinJV and WNV$_{KUN}$ virus was included as a control, as were mosquito cells (RNAi-deficient C6/36 *Aedes* cells).

Figure 81:
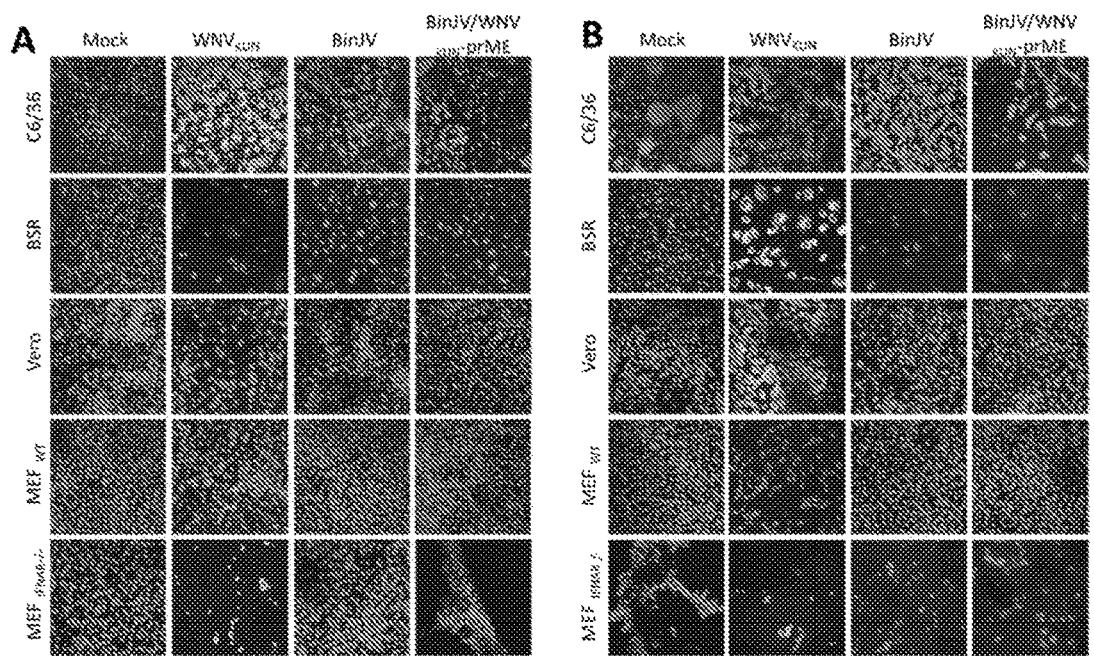
FIG. 81 sets forth an assessment of host restriction of the BinJV-$WNV_{KUN}$-prME chimeric ISF vector at standard temperature (37° C.) and lowered temperature (34° C.). (A) Immunofluorescence images of BinJV, $WNV_{KUN}$, BinJV/$WNV_{KUN}$-prME, and Mock inoculated cell lines C6/36 (mosquito); and BSR, Vero, $MEF_{WT}$ and $MEF_{IFNAR}{}^{-/-}$ (vertebrate) at 37° C. (B) Immunofluorescence images of BinJV, $WNV_{KUN}$, BinJV/$WNV_{KUN}$-prME, and Mock inoculated cell lines C6/36 (mosquito); and BSR, Vero, $MEF_{WT}$ and $MEF_{IFNAR}{}^{-/-}$ (vertebrate) at 34° C.

Results are set forth in FIG. 81. It will be evident from these results that the exemplary chimeric ISF assessed cannot replicate in mammalian cells, even under conditions of lowered temperature. This indicates that chimeric ISFs as described herein may be particularly desirable from a safety perspective, e.g. in the context of use as diagnostics and/or vaccines.

Example 15. Mutation of EDII Fusion Loop

Figure 83:
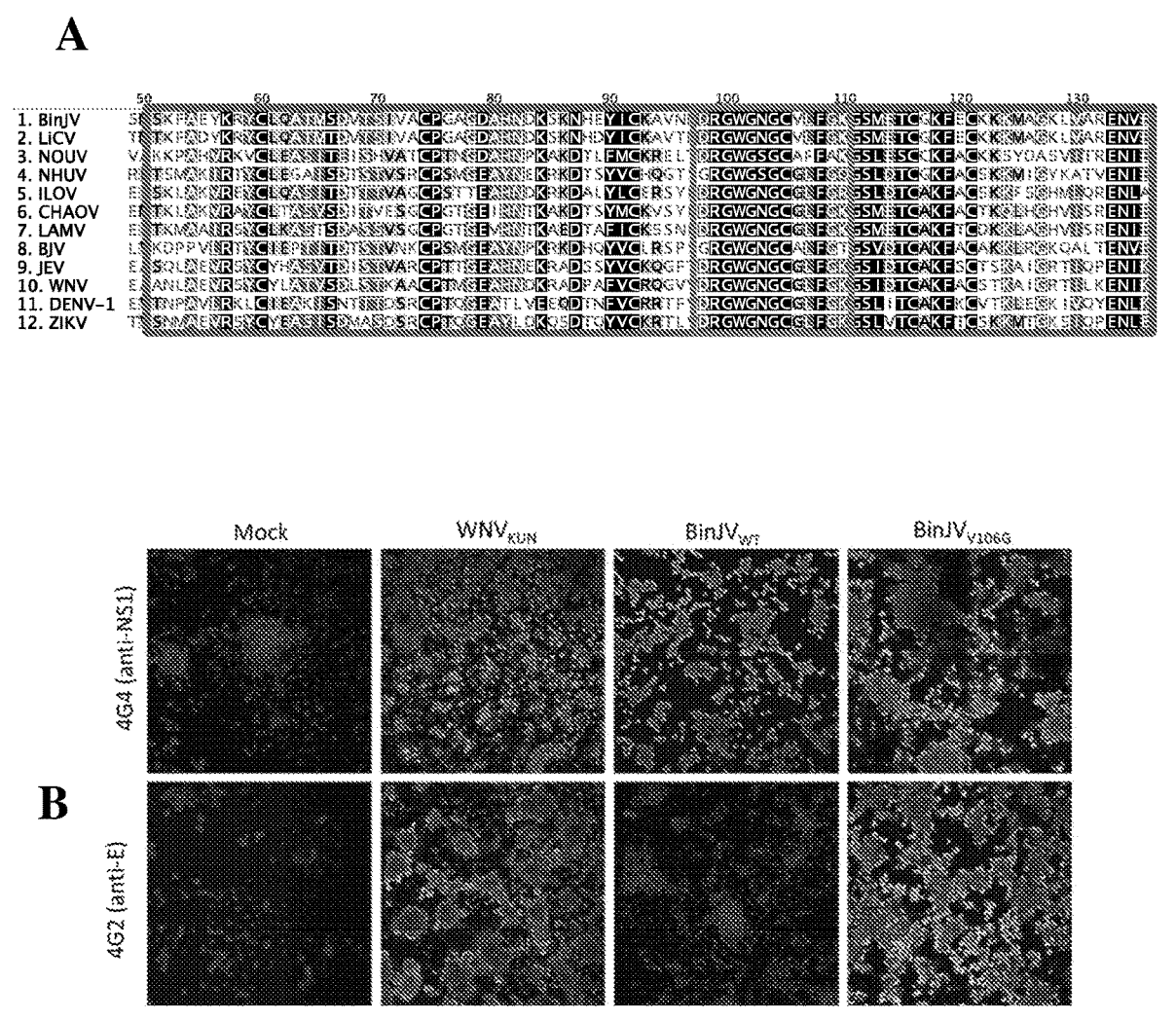

BinJV and LiCV lack an immunodominant residue in its EDII fusion loop (G106V). Only two other linage II ISFs discovered to date similarly lack this residue. The significance of this is that this change in residue results in significantly less cross-reactivity for diagnostic applications. A number of monoclonal antibodies specific to the G106 phenotype are available, of which mAb 4G2 is an example. Due to the G106V substitution that naturally occurs in BinJV, mAb 4G2 does not bind. For the purposes of this invention the BinJV EDII fusion loop has been successfully manipulated to G106 to prove that manipulation of this region is possible, e.g. in other ISFs. IFA analysis using anti-flavivirus NS1 mAb 4G4 and anti-flavivirus E mAb 4G2 was then performed. Results are set forth in FIG. 83.

Example 16. Domain I Chimeras

Figure 84:
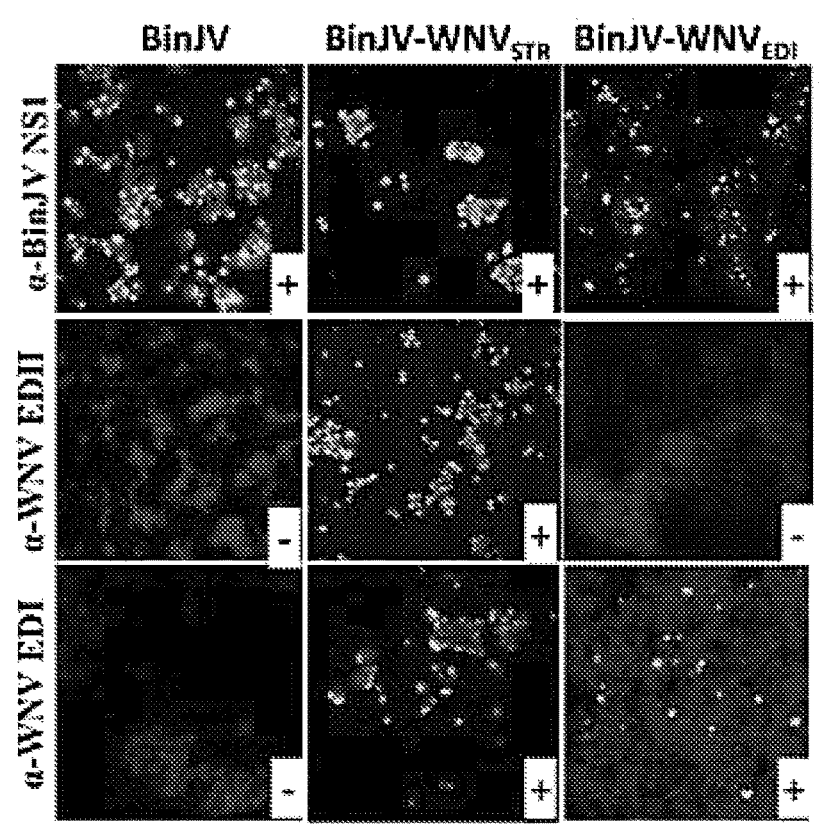

It has previously been shown that a 19 amino acid peptide in domain I of West Nile virus E protein can be used for diagnostic applications (Hobson-Peters et al., 2008, J Gen Virol). However, this 19 amino acid peptide is not typically present in ISF E proteins. For the purposes of this invention, domain I of BinJV has been mutated to express this 19 amino acid peptide. The presence of the domain I peptide was confirmed by binding of a specific antibody, and the BinJV/WNV$_{EDI}$ chimera replicated to high titres (>10$^8$/ml), as set forth in FIG. 84. This confirms that E protein domains can be exchanged between vertebrate infecting flaviviruses and ISFs.

Example 17. PCV-Based Chimeric ISFs

Figure 85:
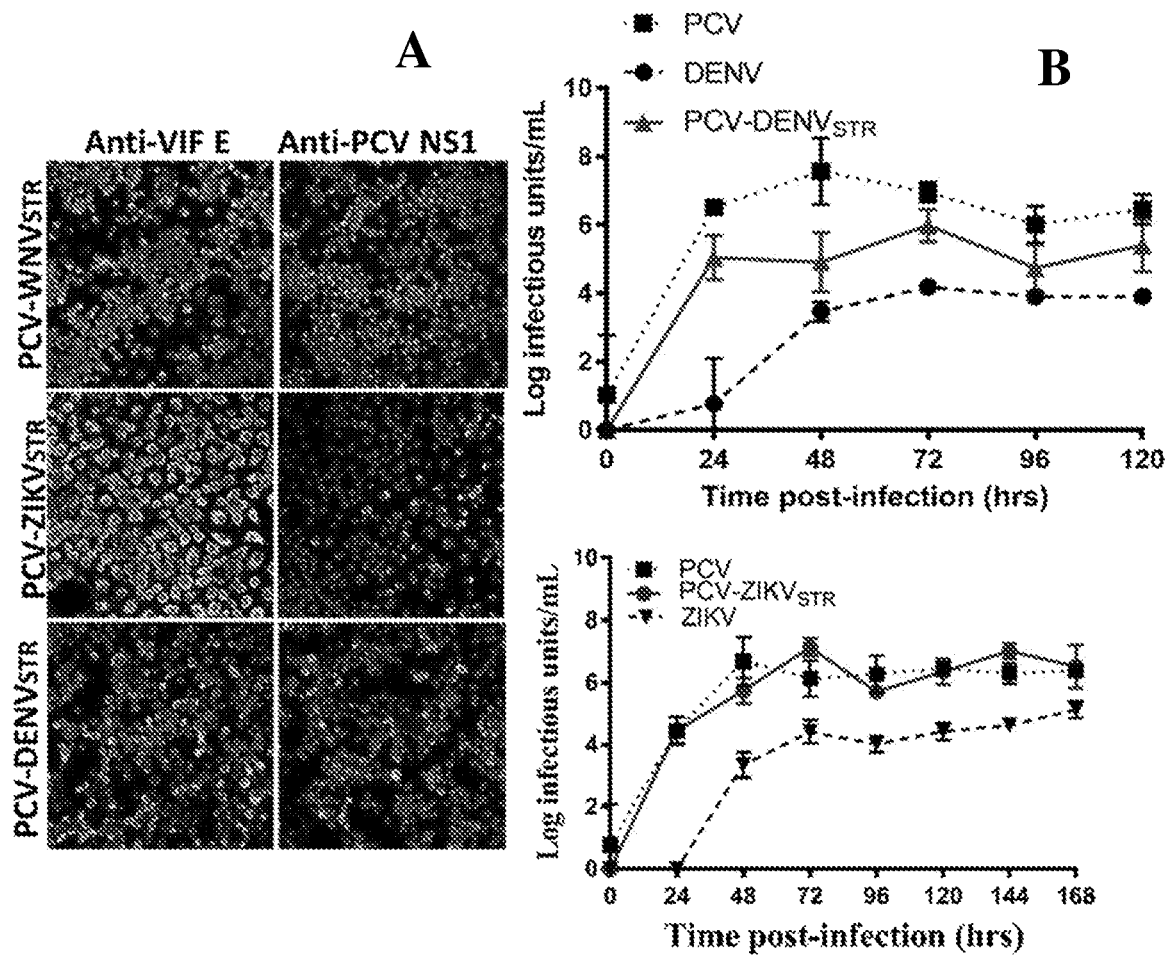
FIG. 85 sets forth (A) immunofluorescent confirmation of production of PCV/Vertebrate-Infecting Flavivirus(VIF)-prME chimeras PCV/DENV-prME (labelled PCV-$DENV_{STR}$), PCV/ZIKV-prME (labelled PCV-$ZIKV_{STR}$), and PCV/$WNV_{KUN}$-prME (labelled PCV-$WNV_{STR}$) in C6/36 mosquito cells; and (B) exemplary assessment of replication of PCV/VIF-prME chimeras in comparison with replication of PCV and the applicable VIF in C6/36 mosquito cells; specifically, replication of PCV, DENV, and PCV/DENV-prME (labelled PCV-$DENV_{STR}$); and replication of PCV, ZIKV, and PCV/ZIKV-prME (labelled PCV-$ZIKV_{STR}$) (bottom) is shown.

As herein described, various chimeric ISF including PCV sequence and sequence from vertebrate-infecting flaviviruses (VIFs) have been produced. Replication of PCV/WNV$_{KUN}$-prME, pCV/DENV-prME, and PCV/ZIKV-prME in mosquito cells, and comparison with replication of the corresponding wild type ISF and VSF has been assessed. Results are presented in FIG. 85.

Example 18. Effect of Passaging on Chimeric ISFs

Figure 86:
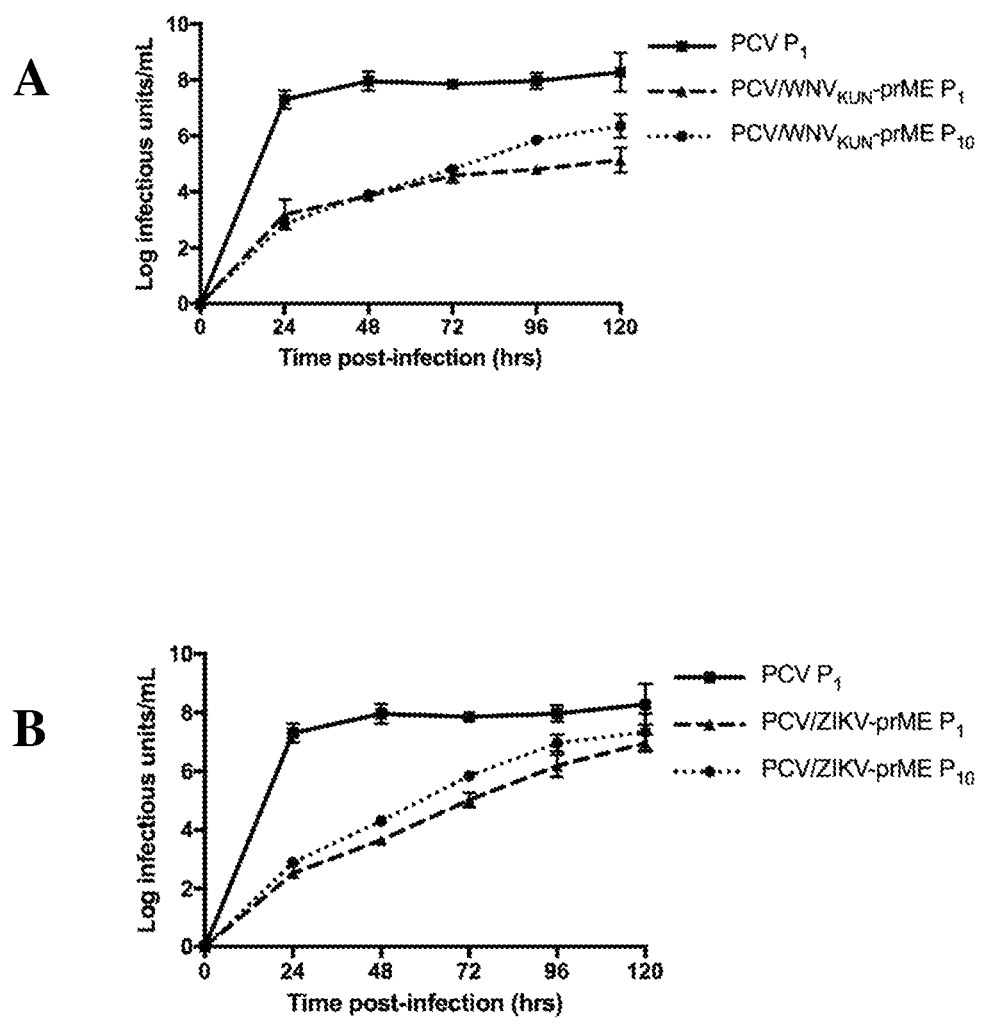

The effect of serially passaging chimeric ISFs as described herein through mosquito cells has been assessed. Specifically, PCV/ZIKV-prME and PCV/WNV$_{KUN}$-prME were passaged serially blind through C6/36 cells. Chimeric ISFs exposed to one passage (P1) (SEQ ID NO:400) and ten passages (P10) (SEQ ID NO:401) were then sequenced and compared Additionally, the growth kinetics of replication of wild type PCV, and P1 and P10 chimeric ISFs in C6/36 cells was compared (FIG. 86)

Based on sequence comparison, the P10 of PCV/ZIKV-prME featured certain genetic changes compared to the P1 of this chimera. Furthermore, replication of the P10 chimeric ISFs was found to be elevated, relative to the P1 ISFs. Without being bound by theory it is considered that genetic changes that occurred during serial passaging resulted in optimisation of replication of the chimeric ISFs in insect cells.

Example 19. Antigenic Authenticity of Chimeric ISFs

For this example, PCV/WNV$_{KUN}$-prME, BinJV/WNV$_{KUN}$-prME, PCV/ZIKV-prME and BinJV/ZIKV-prME chimeras were presented either as purified virions coated onto microwell plates, or as fixed antigens in infected C6/36 mosquito cell monolayers. The antigens were probed with monoclonal antibodies specific to individual domains of WNV or ZIKV envelope protein (EDI, EDII, EDIII), prM or quaternary structures of prM and E. The successful binding of these mAbs to the chimeric viruses confirmed their antigenic authenticity. The absence of WNV and ZIKV NS1 (which is not part of the chimeric constructs) was confirmed by assessing with NS1-specific mAbs. Results are set forth in Tables 2 and 3.

Example 20. Recognition of Chimeric ISFs by Human and Animal Sera

Figure 87:
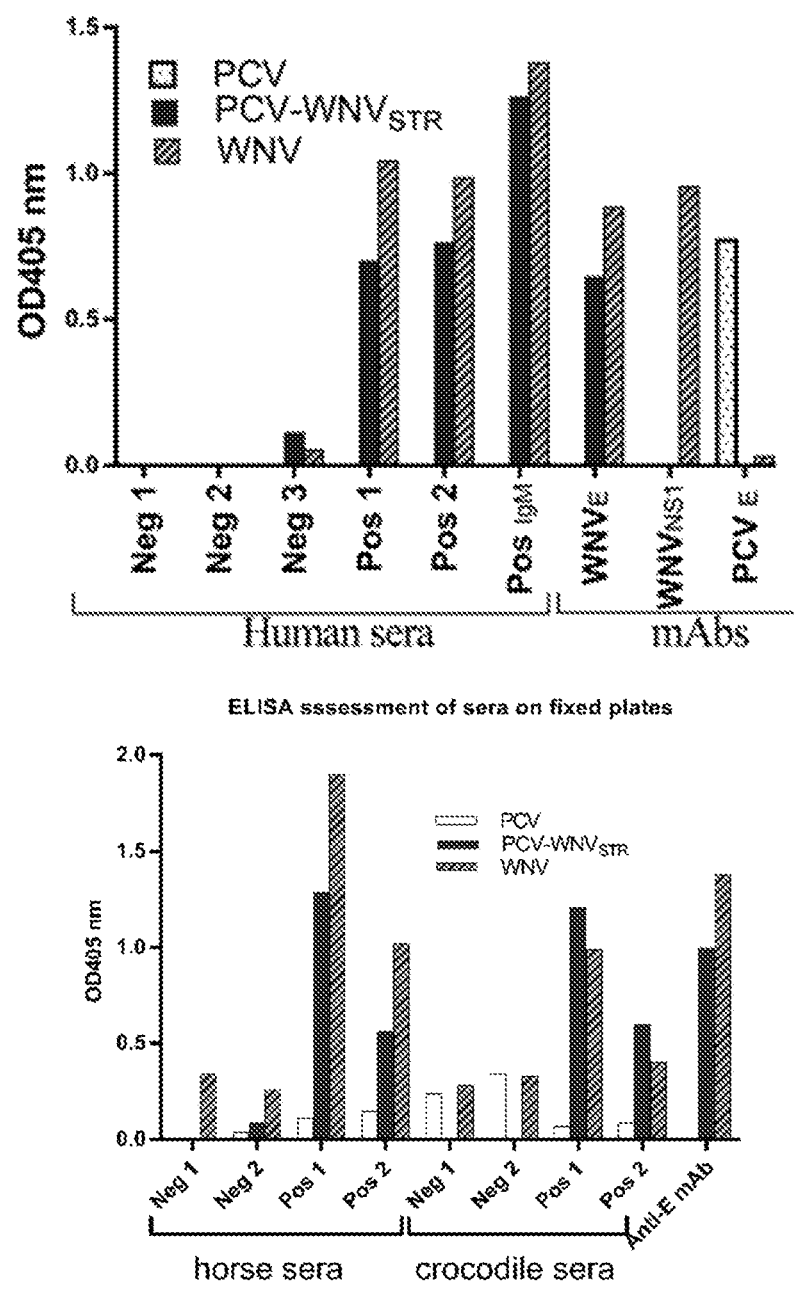

Utility of ISF chimeric viral antigens in diagnostic assays was assessed by study of the binding of immune human, horse and crocodile sera to chimeric ISFs in fixed cell ELISA using virus-infected C6/36 mosquito cell monolayers. Specifically, binding WNV-immune sera to PCV/WNV$_{KUN}$-prME was assessed. As controls, negative human sera and virus-specific monoclonal antibodies were included, as well as wild type PCV and WNV. As set forth in FIG. 87, there was negligible reactivity of naïve sera. In contrast, substantial reactivity of WNV-immune sera with PCV/WNV$_{KUN}$-prME and wild type WNV occurred. Control reactions were essentially as expected.

Figure 88:
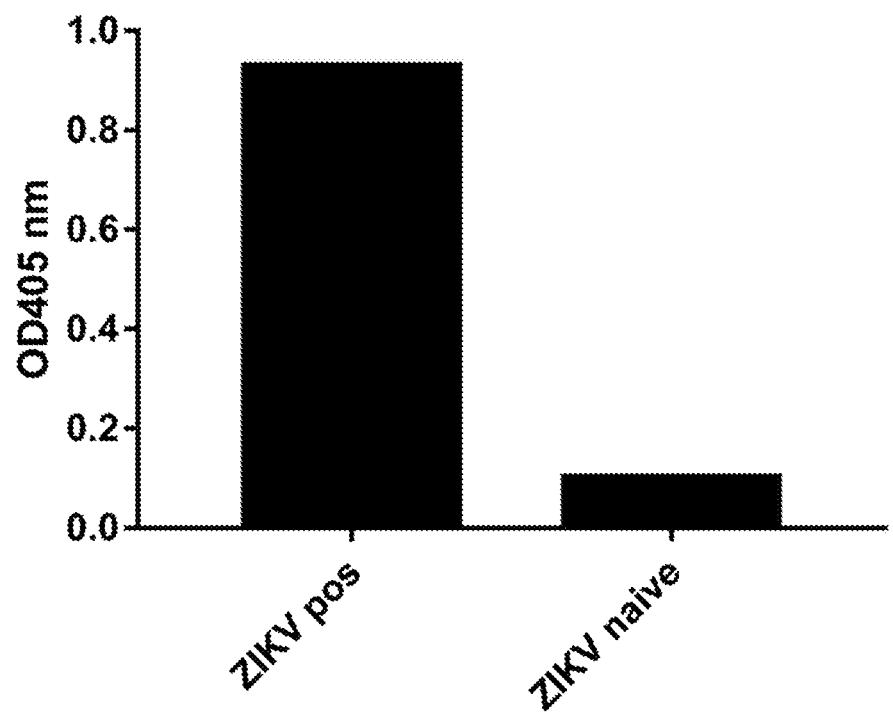
FIG. 88 sets forth binding of PCV/ZIKV-prME particles by ZIKV positive and ZIKV naïve human serum.

Similarly, binding of PCV/ZIKV-prME with ZIKV-immune human sera was assessed in ELISA, as set forth in FIG. 88. Purified PCV/ZIKV-prME virions were coated onto 96-well ELISA microwell plates and probed with human serum at a dilution of 1/320. Bound human antibodies were detected with a HRP-conjugated anti-human Ig. The OD of similarly diluted serum on mock-coated wells was subtracted. The ZIKV positive human serum bound PCV/ZIKV-prME virions strongly, while there was negligible reactivity of a ZIKV-naïve serum.

Example 21. Assessment of Cross-Reactivity of BinJV E Proteins in Chimeric ISFs

Figure 93:
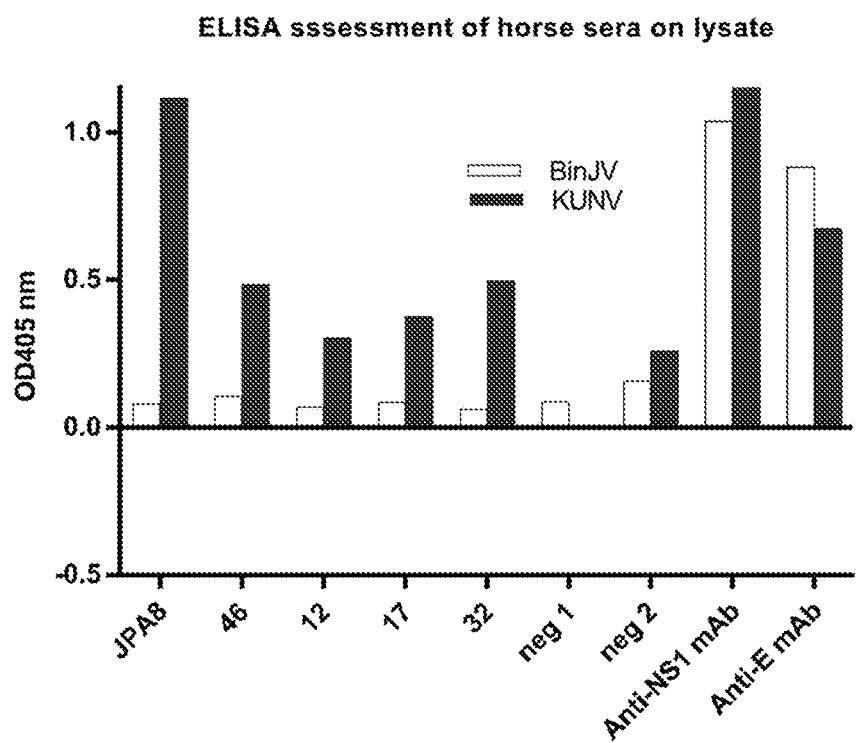
FIG. 93 sets forth an assessment of cross reactivity of BinJV and KUNV.

As set forth in FIG. 93, lysates of BinJV or KUNV-infected cells were coated onto ELISA plates at a predetermined dilution (1/1000) giving the maximum level of E protein binding for both viruses. Comparable amounts of viral antigen were confirmed by the similar binding of anti-NS1 mAb 4G4 and anti-E mAb (4G2 for KUNV and 3A3 for BinJV). WNV-immune horse sera clearly reacted to KUNV lysate (blue bars), while there was negligible reactivity of these sera to BinJV. WNV positive horse sera (experimentally infected with WNV)=JPA8, 46, 12, 17, 32. WNV-naïve horse sera=neg 1, neg 2. Binding of sera to mock lysate subtracted from all readings. These results demonstrate that BinJV E proteins have minimal cross-reactivity when probed with immune sera, indicating that they may make ideal scaffolds for the preparation of E subdomain chimeras.

Example 22. Chimeric ISFs as Vaccines

Figure 89:
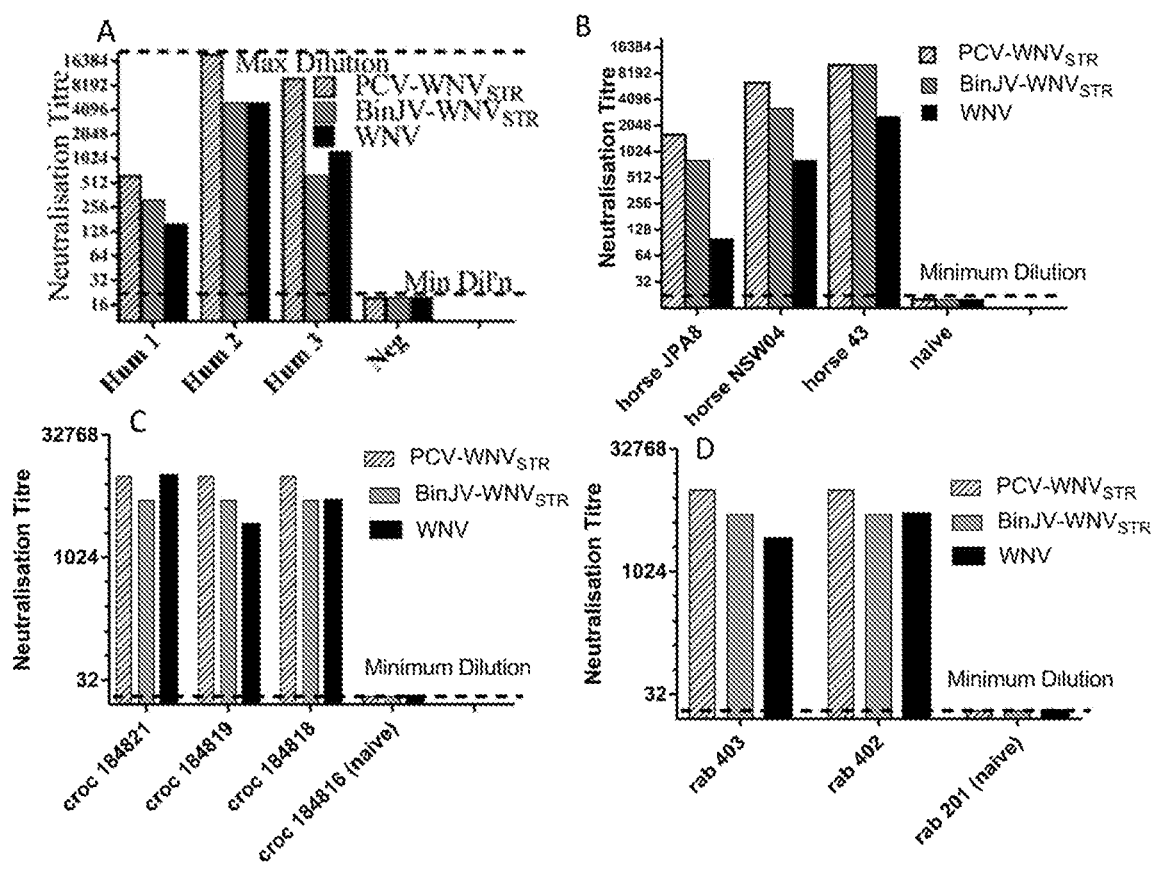
Figure 90:
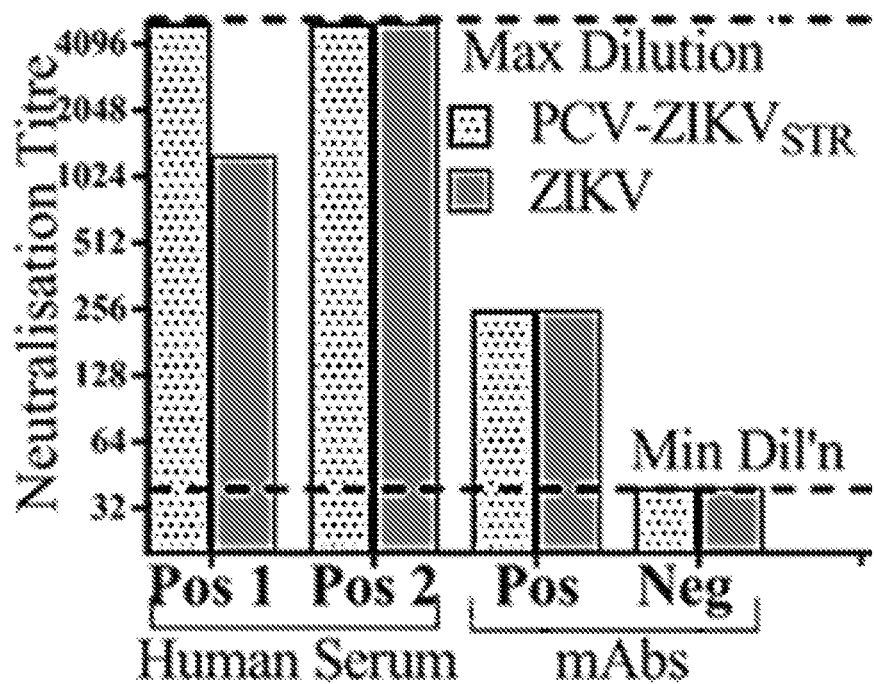
FIG. 90 sets forth neutralisation of PCV/ZIKV-prME (labelled PCV-$ZIKV_{STR}$) and wild type ZIKV replication by dilutions of ZIKV-positive human sera and ZIKV monoclonal antibodies.

As set forth in FIG. 89, WNV-immune human, horse, crocodile, and rabbit sera neutralizes PCV/WNV$_{KUN}$-prME and BinJV/WNV$_{KUN}$-prME with similar efficiency to WNV. Similar findings were observed for PCV/ZIKV-prME as compared with ZIKV (FIG. 90). This is strong evidence that insect specific flavivirus (ISF)/vertebrate infecting flavivirus (VIF) chimeras are antigenically authentic and can induce robust VIF-neutralising responses.

It has also been demonstrated that immunization of mice with purified BinJV particles (2 doses of 10-20 ug of purified particle+Advax) induces a potent neutralising response (titre of 640). This strategy should also be effective using chimeric ISF particles.

Example 23. Codon Optimisation

Insects and mammals have evolved different protein encoding strategies (codon pair bias). There is evidence that ISFs have optimised their codon pair bias to be more similar to that of insects (Colmant et al. (2017) mSphere 2(4) pii: e00262-17). In contrast, it appears that VIFs like WNV, ZIKV, and DENY 'balance' their codon optimisation between insects and mammals Codon optimisation of the VIF prME sequences that have been inserted into chimeric ISF vectors as described herein will be optimised to an insect-like codon pair bias, with the intention of enabling the chimeric ISFs to replicate more efficiently in insect cells, and/or supress their replication in vertebrate cells. As proof of concept for this approach, when the genomes of dengue viruses were recoded to an insect-like codon pair bias, they grew well in insect cells but became highly attenuated in mammalian cells (Shen et al., 2015, PNAS, 112; 4749-4754). Thus, the proposed codon optimisation approach may provide an additional safety mechanism for chimeric ISF applications, and/or improve growth in mosquito cell cultures for scale-up production purposes.

Example 24. Restriction of Unwanted Replication Using miRNA

It has been realised for the invention that it may be possible to provide a further safety measure for use of chimeric ISFs as described herein, e.g., in the context of use as vaccine for vertebrate viruses, using an small RNA (e.g. miRNA)-based approach. Specifically, with reference to Teterina et al., 2014, Virology, 456; 247-258 and Zhou et al., 2014, Parasites & Vectors, 7; 488, it is possible to modulate replication of flaviviruses in specific cells or tissues by incorporating target sequence of regulatory miRNA into the flavivirus sequence.

Accordingly, an approach will be explored wherein target miRNA sequence is incorporated into chimeric ISFs as described herein, to constrain or prevent replication of the chimeric ISF in the mosquito midgut. It will be appreciated that, in the unlikely event that a chimeric ISF was transferred from a vertebrate subject (e.g. after vaccination with the chimeric ISF) to a mosquito by feeding by the mosquito on the subject, the inclusion of such an miRNA target sequence could prevent or constrain replication of the chimeric ISF in the mosquito.

Throughout the specification, the aim has been to describe the preferred embodiments of the invention without limiting the invention to any one embodiment or specific collection of features. Various changes and modifications may be made to the embodiments described and illustrated without departing from the present invention.

The disclosure of each patent and scientific document, computer program and algorithm referred to in this specification is incorporated by reference in its entirety.

Tables

TABLE 1

Primers used for CPEC amplification to produce chimeric insect-specific flavivirus vectors.

| Sequence Name | Name | Direction | Sequence | SEQ ID NO |
|---|---|---|---|---|
| BgV/WNV-prME [CA] | BgV10722R | reverse | GATTCTTGTCGTTTCTCG | 48 |
| BgV/WNV-prME [CA] | BgV10613F | forward | CACACACGGATCACATTGACACC | 49 |
| BgV/WNV-prME [CA] | BgNS5_R | reverse | GTGCTTTAATTTATATCAAG | 50 |
| BgV/WNV-prME [CA] | Bg3'UTR_F | forward | CTTGATATAAATTAAAGCAC | 51 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| BgV/WNV-prME [CA] | BgNS5-30_R | reverse | GGTTGGTTTAATGGAGTGCTTTAATTTATATCAAGCAGCCAATTTCGGAGTGTTCC | 52 |
| BgV/WNV-prME [CA] | BgV9649F | forward | GCTCCCACCATTTCCACCATTTGC | 53 |
| BgV/WNV-prME [CA] | BgNS4B_R | reverse | CTCACCACCTCCTCTTTTGGG | 54 |
| BgV/WNV-prME [CA] | BgNS5_F | forward | CCCAAAAGAGGAGGTGGTGAG | 55 |
| BgV/WNV-prME [CA] | BgNS4B-30_R | reverse | GCCAAGGGTCATGGTCTCACCACCTCCTCTTTTGGGGTTTTGCAATATCC | 56 |
| BgV/WNV-prME [CA] | BgNS5-30_F | forward | GGATATTGCAAAACCCCAAAAGAGGAGGTGGTGAGACCATGACCCTTGGC | 57 |
| BgV/WNV-prME [CA] | BgNS2B_R | reverse | CAAAACTCCACTGCGCTGGC | 58 |
| BgV/WNV-prME [CA] | BgNS3_F | forward | GCCAGCGCAGTGGAGTTTTG | 59 |
| BgV/WNV-prME [CA] | BgVNS2B-30_R | reverse | GGCACGTCCCACAAAACTCCACTGCGCTGGCTTTTGCCTGC | 60 |
| BgV/WNV-prME [CA] | BgVNS2B-30_R | reverse | GGCACGTCCCACAAAACTCCACTGCGCTGGCTTTTGCCTGC | 61 |
| BgV/WNV-prME [CA] | BgVNS3-30_F | forward | GCAGGCAAAAGCCAGCGCAGTGGAGTTTTGTGGGACGTGCC | 62 |
| BgV/WNV-prME [CA] | BgV-NS2A_F | forward | GGTGACGGGATGGAAAATGG | 63 |
| BgV/WNV-prME [CA] | BgV-NS1_R | reverse | GGCACTTACCCATGAAGTGACC | 64 |
| BgV/WNV-prME [CA] | KE/BNS1_R | reverse | GAGCAACCGTACTCAGCATGCACGTTCACGG | 65 |
| BgV/WNV-prME [CA] | KE/BNS1_F | forward | CCGTGAACGTGCATGCTGAGTACGGTTGCTC | 66 |
| BgV/WNV-prME [CA] | KUN-E-Seq-F | forward | GCATGGACCAACTACCG | 67 |
| BgV/WNV-prME [CA] | KUNV-C-prM_R | reverse | GGAAATCTCTGTTGCTCATTCCAAGACAG | 68 |
| BgV/WNV-prME [CA] | KUNV-E_F | forward | CTGTCTTGGAATGAGCAACAGAGATTTCC | 69 |
| BgV/WNV-prME [CA] | BC/KPr_F | forward | GCAACAACATGGGCCGTCACTCTCTCCAAC | 70 |
| BgV/WNV-prME [CA] | BgV-92F | forward | GCACACTAGTTTGTGACATAAGGC | 71 |
| BgV/WNV-prME [CA] | BgV-103F | forward | CGCTTGTTTTGGCACACTAG | 72 |
| BgV/WNV-prME [CA] | BgV10739R | reverse | GCGTACGGATTTTACG | 73 |
| BgV/WNV-prME [CA] | BgV-116Fs | forward | CGTAAAATCCGTACGC | 74 |
| BgV/WNV-prME [CA] | BgV-5UTR-CA-2R | reverse | GTACGGATTTTACGGTTTACCAGATCG | 75 |
| BgV/WNV-prME [CA] | BgV-5UTR-CA-2F | forward | CGATCTGGTAAACCGTAAAATCCGTAC | 76 |
| BgV/WNV-prME [CA] | pUC19-R | reverse | TGGATGGCCTTCCCCATTAT | 77 |
| BgV/WNV-prME [CA] | OplE2-F | forward | CATTATAAGCTGCAATAAACAAGTT | 78 |
| BgV/WNV-prME [CA] | DNA Linker-F | forward | GGGTCGGCATGGCATCTCC | 79 |
| BinJV/WNV-EDIII [CA] | BinJV_NS5-3'_R | reverse | TGCCATGCCGACCCAGATACTTGATGTTTC | 80 |
| BinJV/WNV-EDIII [CA] | BinJV3'UTR-linker | reverse | TGCCATGCCGACCCAGATACTTGATGTTTC | 81 |
| BinJV/WNV-EDIII [CA] | BinJV_NS5-3'Junc_F | forward | GGCAATGTGATCTAAGGATCTACGAACGAG | 82 |
| BinJV/WNV-EDIII [CA] | BinJV_NS5-3'Junc_R | reverse | CTCGTTCGTAGATCCTTAGATCACATTGCC | 83 |
| BinJV/WNV-EDIII [CA] | BinJV_NS5-3'_F | forward | GGAGTTCCTAGGAGGGGATTACAGGCCACC | 84 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| BinJV/WNV-EDIII [CA] | BinJV_3-4B_R | reverse | GGTGGCCTGTAATCCCCTCCTAGGAACTCC | 85 |
| BinJV/WNV-EDIII [CA] | BinJV_3-4B_F | forward | AAATCAAACAAGCGGGGACTGTGTTGTGG | 86 |
| BinJV/WNV-EDIII [CA] | BinJV_1-2B_R | reverse | CCACAACACAGTCCCCCGCTTGTTTGATTT | 87 |
| BinJV/WNV-EDIII [CA] | BinJV_1-2B_F | forward | GTGACCGTGGGTGCCCTATCGGAAATAGGA | 88 |
| BinJV/WNV-EDIII [CA] | BinJV_5'-E_R | reverse | TCCTATTTCCGATAGGGCACCCACGGTCAC | 89 |
| BinJV/WNV-EDIII [CA] | BinJV-E_F | forward | GCTCCGTCATATGGTAACCAATGCCTGGAT | 90 |
| BinJV/WNV-EDIII [CA] | BinJV-M_R | reverse | ATCCAGGCATTGGTTACCATATGACGGAGC | 91 |
| BinJV/WNV-EDIII [CA] | BinJV_5'-E_F | forward | AACGATCTGGTAAACAGTATATTTTGCGTG | 92 |
| BinJV/WNV-EDIII [CA] | Linker-BinJV5'UTR | reverse | CACGCAAAATATACTGTTTACCAGATCGTT | 93 |
| BinJV/WNV-EDIII [CA] | pUC19-R | reverse | TGGATGGCCTTCCCCATTAT | 94 |
| BinJV/WNV-EDIII [CA] | OpIE2-F | forward | CATTATAAGCTGCAATAAACAAGTT | 95 |
| BinJV/WNV-EDIII [CA] | DNA Linker-F | forward | GGGTCGGCATGGCATCTCC | 96 |
| WNV/BgV-prME [CA] | KUNV-3'UTR_R | reverse | TCCTGTGTTCTCGCACCAC | 97 |
| WNV/BgV-prME [CA] | KUNV-UTRlinker_F | forward | GTGGTGCGAGAACACAGGA | 98 |
| WNV/BgV-prME [CA] | KUN-NS5(only)-R | reverse | TTACAATACTGTATCCTCAACCAATG | 99 |
| WNV/BgV-prME [CA] | KUNV-NS5_R | reverse | CTGTATCCTCAACCAATGTTGTGTCTTC | 100 |
| WNV/BgV-prME [CA] | KUNV-3'UTR_F | forward | GAAGACACAACATTGGTTGAGGATACAG | 101 |
| WNV/BgV-prME [CA] | KUN-NS5(only)-F | forward | GGTGGGGCAAAAGGAC | 102 |
| WNV/BgV-prME [CA] | KUNV-NS4B_R | reverse | CGTCCTTTTGCCCCACCTC | 103 |
| WNV/BgV-prME [CA] | KUNV-NS5_F | forward | GAGGTGGGGCAAAAGGACG | 104 |
| WNV/BgV-prME [CA] | KUNV-NS4A_R | reverse | CCCATCTCATTGGCTGCCAC | 105 |
| WNV/BgV-prME [CA] | KUNV-NS4B_F | forward | GTGGCAGCCAATGAGATGGG | 106 |
| WNV/BgV-prME [CA] | qWNns4A_R | reverse | TAGCTGGTTGTCTGTCTGCG | 107 |
| WNV/BgV-prME [CA] | qWNns4A_F | forward | TTGAGTGTGATGACCATGGGAG | 108 |
| WNV/BgV-prME [CA] | KUNV-NS3_R | reverse | GACCTCGATAAAACCTATTTGAGAGCGC | 109 |
| WNV/BgV-prME [CA] | KUNV-NS4A_F | forward | GCGCTCTCAAATAGGTTTTATCGAGGTC | 110 |
| WNV/BgV-prME [CA] | KUNV-NS2B_R | reverse | CTCCTCTCTTTGTGTATTGGAGAGTTATC | 111 |
| WNV/BgV-prME [CA] | KUNV-NS3_F | forward | GATAACTCTCCAATACACAAAGAGAGGAG | 112 |
| WNV/BgV-prME [CA] | KUNV-NS2A_R | reverse | CTTCAGTTGCAGGCCACCC | 113 |
| WNV/BgV-prME [CA] | KUNV-NS2B_F | forward | GGGTGGCCTGCAACTGAAG | 114 |
| WNV/BgV-prME [CA] | KUNV-NS1_R | reverse | GAAAAGGATCAATCATGTCAGCGTTGTAG | 115 |
| WNV/BgV-prME [CA] | KUNV-NS2A_F | forward | CTACAACGCTGACATGATTGATCCTTTTC | 116 |
| WNV/BgV-prME [CA] | KUN-NS1-INT_R | reverse | CGGTCCATCCAAGCTTCCAC | 117 |
| WNV/BgV-prME [CA] | BE/KNS1-15_R | reverse | GGCACATCCAGTATCAGCGTTAACTCCAAG | 118 |
| WNV/BgV-prME [CA] | BE/KNS1-15_F | forward | CTTGGAGTTAACGCTGATACTGGATGTGCC | 119 |
| WNV/BgV-prME [CA] | BE/KNS1_R | reverse | CCGACTTATATCTATGGCACATCCAGTATCAGCGTTAACTCCAAGTGTCATGAACAACAG | 120 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| WNV/BgV-prME [CA] | BE/KNS1_F | forward | CTGTTTGTTCATGACACTTGGAGTTAACGCTGATACTGGAT GTGCCATAGATATAAGTCGG | 121 |
| WNV/BgV-prME [CA] | K/B(S)-E-SEQ_F | forward | GATAGGTGTGAACTCCCGCAATG | 122 |
| WNV/BgV-prME [CA] | BgVE_F | forward | CCTGCTTACGGCTCTCACTGCATTG | 123 |
| WNV/BgV-prME [CA] | BgV-PrM_R | forward | GGCAATTGGACCTGCTTACG | 124 |
| WNV/BgV-prME [CA] | BgV531R | reverse | GCAATCAATGTCGTCAGGCTCTTCC | 125 |
| WNV/BgV-prME [CA] | K/B(S)-Pr-SEQ_R | reverse | CACCAGTATCCAGCATCATTGATG | 126 |
| WNV/BgV-prME [CA] | KC/BPr-15_R | reverse | CTTCCTGAGAGTTAATGCTCCCACGCCAG | 127 |
| WNV/BgV-prME [CA] | KC/BPr-15_F | forward | CTGGCGTGGGAGCATTAACTCTCAGGAAG | 128 |
| WNV/BgV-prME [CA] | KC/BPr_R | reverse | AATAGTGTTGTCAATCTTCCTGAGAGTTAATGCTCCCACG CCAGCAATCAAGCCAATCAT | 129 |
| WNV/BgV-prME [CA] | KC/BPr_F | forward | ATGATTGGCTTGATTGCTGGCGTGGGAGCATTAACTCTCA GGAAGATTGACAACACTATT | 130 |
| WNV/BgV-prME [CA] | K/B(S)-C-SEQ_F | forward | CAGAAGAAGAGAGGAGGAAAGACC | 131 |
| WNV/BgV-prME [CA] | KUNV-5'UTR_R | reverse | GGCCCTCCTGGTTTCTTAGAC | 132 |
| WNV/BgV-prME [CA] | KUNV-C-prM_F | forward | GTCTAAGAAACCAGGAGGGCC | 133 |
| WNV/BgV-prME [CA] | KUNV-UTRlinker_R | reverse | CAGCTCACACAGGCGAACTACT | 134 |
| WNV/BgV-prME [CA] | KUNV-5'UTR_F | forward | AGTAGTTCGCCTGTGTGAGCTG | 135 |
| WNV/BgV-prME [CA] | pUC19-R | reverse | TGGATGGCCTTCCCCATTAT | 136 |
| WNV/BgV-prME [CA] | OpIE2-F | forward | CATTATAAGCTGCAATAAACAAGTT | 137 |
| WNV/BgV-prME [CA] | DNA Linker-F | forward | GGGTCGGCATGGCATCTCC | 138 |
| WNV/BinJV-prME [CA] | KUNV-3'UTR_R | reverse | TCCTGTGTTCTCGCACCAC | 139 |
| WNV/BinJV-prME [CA] | KUNV-UTRlinker_F | forward | GTGGTGCGAGAACACAGGA | 140 |
| WNV/BinJV-prME [CA] | KUN-NS5(only)-R | reverse | TTACAATACTGTATCCTCAACCAATG | 141 |
| WNV/BinJV-prME [CA] | KUNV-NS5_R | reverse | CTGTATCCTCAACCAATGTTGTGTCTTC | 142 |
| WNV/BinJV-prME [CA] | KUNV-3'UTR_F | forward | GAAGACACAACATTGGTTGAGGATACAG | 143 |
| WNV/BinJV-prME [CA] | KUN-NS5(only)-F | forward | GGTGGGGCAAAAGGAC | 144 |
| WNV/BinJV-prME [CA] | KUNV-NS4B_R | reverse | CGTCCTTTTGCCCCACCTC | 145 |
| WNV/BinJV-prME [CA] | KUNV-NS5_F | forward | GAGGTGGGGCAAAAGGACG | 146 |
| WNV/BinJV-prME [CA] | KUNV-NS4A_R | reverse | CCCATCTCATTGGCTGCCAC | 147 |
| WNV/BinJV-prME [CA] | KUNV-NS4B_F | forward | GTGGCAGCCAATGAGATGGG | 148 |
| WNV/BinJV-prME [CA] | qWNns4A_R | reverse | TAGCTGGTTGTCTGTCTGCG | 149 |
| WNV/BinJV-prME [CA] | qWNns4A_F | forward | TTGAGTGTGATGACCATGGGAG | 150 |
| WNV/BinJV-prME [CA] | KUNV-NS3_R | reverse | GACCTCGATAAAACCTATTTGAGAGCGC | 151 |
| WNV/BinJV-prME [CA] | KUNV-NS4A_F | forward | GCGCTCTCAAATAGGTTTTATCGAGGTC | 152 |
| WNV/BinJV-prME [CA] | KUNV-NS2B_R | reverse | CTCCTCTCTTTGTGTATTGGAGAGTTATC | 153 |
| WNV/BinJV-prME [CA] | KUNV-NS3_F | forward | GATAACTCTCCAATACACAAAGAGAGGAG | 154 |
| WNV/BinJV-prME [CA] | KUNV-NS2A_R | reverse | CTTCAGTTGCAGGCCACCC | 155 |
| WNV/BinJV-prME [CA] | KUNV-NS2B_F | forward | GGGTGGCCTGCAACTGAAG | 156 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| WNV/BinJV-prME [CA] | KUNV-NS1_R | reverse | GAAAAGGATCAATCATGTCAGCGTTGTAG | 157 |
| WNV/BinJV-prME [CA] | KUNV-NS2A_F | forward | CTACAACGCTGACATGATTGATCCTTTTC | 158 |
| WNV/BinJV-prME [CA] | KUN-NS1-INT_R | reverse | CGGTCCATCCAAGCTTCCAC | 159 |
| WNV/BinJV-prME [CA] | BinE-KUN1R | reverse | GGCACATCCAGTATCGGCACCCACGGTCAC | 160 |
| WNV/BinJV-prME [CA] | BinE-KUN1F | forward | GTGACCGTGGGTGCCGATACTGGATGTGCC | 161 |
| WNV/BinJV-prME [CA] | BinJV-M_R | reverse | ATCCAGGCATTGGTTACCATATGACGGAGC | 162 |
| WNV/BinJV-prME [CA] | BinJV-E_F | forward | GCTCCGTCATATGGTAACCAATGCCTGGAT | 163 |
| WNV/BinJV-prME [CA] | KUNC-BinprR | reverse | GGCTATCGTGATTGCTGCTCCCACGCCAGC | 164 |
| WNV/BinJV-prME [CA] | KUNC-BinprF | forward | GCTGGCGTGGGAGCAGCAATCACGATAGCC | 165 |
| WNV/BinJV-prME [CA] | K/B(S)-C-SEQ_F | forward | CAGAAGAAGAGAGGAGGAAAGACC | 166 |
| WNV/BinJV-prME [CA] | KUNV-5'UTR_R | reverse | GGCCCTCCTGGTTTCTTAGAC | 167 |
| WNV/BinJV-prME [CA] | KUNV-C-prM_F | forward | GTCTAAGAAACCAGGAGGGCC | 168 |
| WNV/BinJV-prME [CA] | KUNV-UTRlinker_R | reverse | CAGCTCACACAGGCGAACTACT | 169 |
| WNV/BinJV-prME [CA] | KUNV-5'UTR_F | forward | AGTAGTTCGCCTGTGTGAGCTG | 170 |
| WNV/BinJV-prME [CA] | pUC19-R | reverse | TGGATGGCCTTCCCCATTAT | 171 |
| WNV/BinJV-prME [CA] | OpIE2-F | forward | CATTATAAGCTGCAATAAACAAGTT | 172 |
| WNV/BinJV-prME [CA] | DNA Linker-F | forward | GGGTCGGCATGGCATCTCC | 173 |
| WNV/CFAV-prME [CA] | KUNV-3'UTR_R | reverse | TCCTGTGTTCTCGCACCAC | 174 |
| WNV/CFAV-prME [CA] | KUNV-UTRlinker_F | forward | GTGGTGCGAGAACACAGGA | 175 |
| WNV/CFAV-prME [CA] | KUN-NS5(only)-R | reverse | TTACAATACTGTATCCTCAACCAATG | 176 |
| WNV/CFAV-prME [CA] | KUNV-NS5_R | reverse | CTGTATCCTCAACCAATGTTGTGTCTTC | 177 |
| WNV/CFAV-prME [CA] | KUNV-3'UTR_F | forward | GAAGACACAACATTGGTTGAGGATACAG | 178 |
| WNV/CFAV-prME [CA] | KUN-NS5(only)-F | forward | GGTGGGGCAAAAGGAC | 179 |
| WNV/CFAV-prME [CA] | KUNV-NS4B_R | reverse | CGTCCTTTTGCCCCACCTC | 180 |
| WNV/CFAV-prME [CA] | KUNV-NS5_F | forward | GAGGTGGGGCAAAAGGACG | 181 |
| WNV/CFAV-prME [CA] | KUNV-NS4A_R | reverse | CCCATCTCATTGGCTGCCAC | 182 |
| WNV/CFAV-prME [CA] | KUNV-NS4B_F | forward | GTGGCAGCCAATGAGATGGG | 183 |
| WNV/CFAV-prME [CA] | qWNns4A R | reverse | TAGCTGGTTGTCTGTCTGCG | 184 |
| WNV/CFAV-prME [CA] | qWNns4A F | forward | TTGAGTGTGATGACCATGGGAG | 185 |
| WNV/CFAV-prME [CA] | KUNV-NS3_R | reverse | GACCTCGATAAAACCTATTTGAGAGCGC | 186 |
| WNV/CFAV-prME [CA] | KUNV-NS4A_F | forward | GCGCTCTCAAATAGGTTTTATCGAGGTC | 187 |
| WNV/CFAV-prME [CA] | KUNV-NS2B_R | reverse | CTCCTCTCTTTGTGTATTGGAGAGTTATC | 188 |
| WNV/CFAV-prME [CA] | KUNV-NS3_F | forward | GATAACTCTCCAATACACAAAGAGGAG | 189 |
| WNV/CFAV-prME [CA] | KUNV-NS2A_R | reverse | CTTCAGTTGCAGGCCACCC | 190 |
| WNV/CFAV-prME [CA] | KUNV-NS2B_F | forward | GGGTGGCCTGCAACTGAAG | 191 |
| WNV/CFAV-prME [CA] | KUNV-NS1_R | reverse | GAAAAGGATCAATCATGTCAGCGTTGTAG | 192 |
| WNV/CFAV-prME [CA] | KUNV-NS2A_F | forward | CTACAACGCTGACATGATTGATCCTTTTC | 193 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| WNV/CFAV-prME [CA] | KUN-NS1-INT_R | reverse | CGGTCCATCCAAGCTTCCAC | 194 |
| WNV/CFAV-prME [CA] | CFAV-E/KUN-NS1_R | reverse | GGCACATCCAGTATCAGCCCGCACATAGTA | 195 |
| WNV/CFAV-prME [CA] | CFAV-E/KUN-NS1_F | forward | TACTATGTGCGGGCTGATACTGGATGTGCC | 196 |
| WNV/CFAV-prME [CA] | CFAV-Pr_R | reverse | AAACTCCCCCTTTACTGTGGTCCAAGTGCC | 197 |
| WNV/CFAV-prME [CA] | CFAV-E_F | forward | GGCACTTGGACCACAGTAAAGGGGGAGTTT | 198 |
| WNV/CFAV-prME [CA] | KUN-C/CFAV-Pr_R | reverse | CATGTCAATCACCACTGCTCCCACGCCAGC | 199 |
| WNV/CFAV-prME [CA] | KUN-C/CFAV-Pr_F | forward | GCTGGCGTGGGAGCAGTGGTGATTGACATG | 200 |
| WNV/CFAV-prME [CA] | K/B(S)-C-SEQ_F | forward | CAGAAGAAGAGAGGAGGAAAGACC | 201 |
| WNV/CFAV-prME [CA] | KUNV-5'UTR_R | reverse | GGCCCTCCTGGTTTCTTAGAC | 202 |
| WNV/CFAV-prME [CA] | KUNV-C-prM_F | forward | GTCTAAGAAACCAGGAGGGCC | 203 |
| WNV/CFAV-prME [CA] | KUNV-UTRlinker_R | reverse | CAGCTCACACAGGCGAACTACT | 204 |
| WNV/CFAV-prME [CA] | KUNV-5'UTR_F | forward | AGTAGTTCGCCTGTGTGAGCTG | 205 |
| WNV/CFAV-prME [CA] | pUC19-R | reverse | TGGATGGCCTTCCCCATTAT | 206 |
| WNV/CFAV-prME [CA] | OpIE2-F | forward | CATTATAAGCTGCAATAAACAAGTT | 207 |
| WNV/CFAV-prME [CA] | DNA Linker-F | forward | GGGTCGGCATGGCATCTCC | 208 |
| WNV/KRBV-prME [CA] | KUNV-3'UTR_R | reverse | TCCTGTGTTCTCGCACCAC | 209 |
| WNV/KRBV-prME [CA] | KUNV-UTRlinker_F | forward | GTGGTGCGAGAACACAGGA | 210 |
| WNV/KRBV-prME [CA] | KUN-NS5(only)-R | reverse | TTACAATACTGTATCCTCAACCAATG | 211 |
| WNV/KRBV-prME [CA] | KUNV-NS5_R | reverse | CTGTATCCTCAACCAATGTTGTGTCTTC | 212 |
| WNV/KRBV-prME [CA] | KUNV-3'UTR_F | forward | GAAGACACAACATTGGTTGAGGATACAG | 213 |
| WNV/KRBV-prME [CA] | KUN-NS5(only)-F | forward | GGTGGGGCAAAAGGAC | 214 |
| WNV/KRBV-prME [CA] | KUNV-NS4B_R | reverse | CGTCCTTTTGCCCCACCTC | 215 |
| WNV/KRBV-prME [CA] | KUNV-NS5_F | forward | GAGGTGGGGCAAAAGGACG | 216 |
| WNV/KRBV-prME [CA] | KUNV-NS4A_R | reverse | CCCATCTCATTGGCTGCCAC | 217 |
| WNV/KRBV-prME [CA] | KUNV-NS4B_F | forward | GTGGCAGCCAATGAGATGGG | 218 |
| WNV/KRBV-prME [CA] | qWNns4A_R | reverse | TAGCTGGTTGTCTGTCTGCG | 219 |
| WNV/KRBV-prME [CA] | qWNns4A_F | forward | TTGAGTGTGATGACCATGGGAG | 220 |
| WNV/KRBV-prME [CA] | KUNV-NS3_R | reverse | GACCTCGATAAAACCTATTTGAGAGCGC | 221 |
| WNV/KRBV-prME [CA] | KUNV-NS4A_F | forward | GCGCTCTCAAATAGGTTTTATCGAGGTC | 222 |
| WNV/KRBV-prME [CA] | KUNV-NS2B_R | reverse | CTCCTCTCTTTGTGTATTGGAGAGTTATC | 223 |
| WNV/KRBV-prME [CA] | KUNV-NS3_F | forward | GATAACTCTCCAATACACAAAGAGGAG | 224 |
| WNV/KRBV-prME [CA] | KUNV-NS2A_R | reverse | CTTCAGTTGCAGGCCACCC | 225 |
| WNV/KRBV-prME [CA] | KUNV-NS2B_F | forward | GGGTGGCCTGCAACTGAAG | 226 |
| WNV/KRBV-prME [CA] | KUNV-NS1_R | reverse | GAAAGGATCAATCATGTCAGCGTTGTAG | 227 |
| WNV/KRBV-prME [CA] | KUNV-NS2A_F | forward | CTACAACGCTGACATGATTGATCCTTTTC | 228 |
| WNV/KRBV-prME [CA] | KUN-NS1-INT_R | reverse | CGGTCCATCCAAGCTTCCAC | 229 |
| WNV/KRBV-prME [CA] | Kr-E/Ku-NS1_R | reverse | GGCACATCCAGTATCAGCTCGCACGTATGT | 230 |
| WNV/KRBV-prME [CA] | Kr-E/Ku-NS1_F | forward | ACATACGTGCGAGCTGATACTGGATGTGCC | 231 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| WNV/KRBV-prME [CA] | Ku-C/Kr-E_R | reverse | TCCATTCATGGTCTTTGCTCCCACGCCAGC | 232 |
| WNV/KRBV-prME [CA] | Ku-C/Kr-E_F | forward | GCTGGCGTGGGAGCAAAGACCATGAATGGA | 233 |
| WNV/KRBV-prME [CA] | K/B(S)-C-SEQ_F | forward | CAGAAGAAGAGAGGAGGAAAGACC | 234 |
| WNV/KRBV-prME [CA] | KUNV-5'UTR_R | reverse | GGCCCTCCTGGTTTCTTAGAC | 235 |
| WNV/KRBV-prME [CA] | KUNV-C-prM_F | forward | GTCTAAGAAACCAGGAGGGCC | 236 |
| WNV/KRBV-prME [CA] | KUNV-UTRlinker_R | reverse | CAGCTCACACAGGCGAACTACT | 237 |
| WNV/KRBV-prME [CA] | KUNV-5'UTR_F | forward | AGTAGTTCGCCTGTGTGAGCTG | 238 |
| WNV/KRBV-prME [CA] | pUC19-R | reverse | TGGATGGCCTTCCCCATTAT | 239 |
| WNV/KRBV-prME [CA] | OpIE2-F | forward | CATTATAAGCTGCAATAAACAAGTT | 240 |
| WNV/KRBV-prME [CA] | DNA Linker - F | forward | GGGTCGGCATGGCATCTCC | 241 |
| WNV/PaRV-prME [CA] | KUNV-3'UTR_R | reverse | TCCTGTGTTCTCGCACCAC | 242 |
| WNV/PaRV-prME [CA] | KUNV-UTRlinker_F | forward | GTGGTGCGAGAACACAGGA | 243 |
| WNV/PaRV-prME [CA] | KUN-NS5(only)-R | reverse | TTACAATACTGTATCCTCAACCAATG | 244 |
| WNV/PaRV-prME [CA] | KUNV-NS5_R | reverse | CTGTATCCTCAACCAATGTTGTGTCTTC | 245 |
| WNV/PaRV-prME [CA] | KUNV-3'UTR_F | forward | GAAGACACAACATTGGTTGAGGATACAG | 246 |
| WNV/PaRV-prME [CA] | KUN-NS5(only)-F | forward | GGTGGGGCAAAAGGAC | 247 |
| WNV/PaRV-prME [CA] | KUNV-NS4B_R | reverse | CGTCCTTTTGCCCCACCTC | 248 |
| WNV/PaRV-prME [CA] | KUNV-NS5_F | forward | GAGGTGGGGCAAAAGGACG | 249 |
| WNV/PaRV-prME [CA] | KUNV-NS4A_R | reverse | CCCATCTCATTGGCTGCCAC | 250 |
| WNV/PaRV-prME [CA] | KUNV-NS4B_F | forward | GTGGCAGCCAATGAGATGGG | 251 |
| WNV/PaRV-prME [CA] | qWNns4A_R | reverse | TAGCTGGTTGTCTGTCTGCG | 252 |
| WNV/PaRV-prME [CA] | qWNns4A_F | forward | TTGAGTGTGATGACCATGGGAG | 253 |
| WNV/PaRV-prME [CA] | KUNV-NS3_R | reverse | GACCTCGATAAAACCTATTTGAGAGCGC | 254 |
| WNV/PaRV-prME [CA] | KUNV-NS4A_F | forward | GCGCTCTCAAATAGGTTTTATCGAGGTC | 255 |
| WNV/PaRV-prME [CA] | KUNV-NS2B_R | reverse | CTCCTCTCTTTGTGTATTGGAGAGTTATC | 256 |
| WNV/PaRV-prME [CA] | KUNV-NS3_F | forward | GATAACTCTCCAATACACAAAGAGAGGAG | 257 |
| WNV/PaRV-prME [CA] | KUNV-NS2A_R | reverse | CTTCAGTTGCAGGCCACCC | 258 |
| WNV/PaRV-prME [CA] | KUNV-NS2B_F | forward | GGGTGGCCTGCAACTGAAG | 259 |
| WNV/PaRV-prME [CA] | KUNV-NS1_R | reverse | GAAAAGGATCAATCATGTCAGCGTTGTAG | 260 |
| WNV/PaRV-prME [CA] | KUNV-NS2A_F | forward | CTACAACGCTGACATGATTGATCCTTTTC | 261 |
| WNV/PaRV-prME [CA] | KUN-NS1-INT_R | reverse | CGGTCCATCCAAGCTTCCAC | 262 |
| WNV/PaRV-prME [CA] | PE/KNS1_R | reverse | CACATCCAGTATCAGCTCGGGTATAAG | 263 |
| WNV/PaRV-prME [CA] | PE/KNS1_F | forward | CTTATACCCGAGCTGATACTGGATGTG | 264 |
| WNV/PaRV-prME [CA] | PE/KNS1.2_R | reverse | CCGACTTATATCTATGGCACATCCAGTATCAGCTCGGGTA TAAGCGATTCCACAGAGGAT | 265 |
| WNV/PaRV-prME [CA] | PE/KNS1.2_F | forward | ATCCTCTGTGGAATCGCTTATACCCGAGCTGATACTGGAT GTGCCATAGATATAAGTCGG | 266 |
| WNV/PaRV-prME [CA] | SwV qE-R | reverse | AAACATCCGGTTCCCCATCC | 267 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| WNV/PaRV-prME [CA] | SwV qE-F | forward | ATTCGACCGACATATGCCCC | 268 |
| WNV/PaRV-prME [CA] | PaRV-C-prM-R_R | reverse | CCAAGAATGGCTCAACAAACTCACC | 269 |
| WNV/PaRV-prME [CA] | PaRV-E_F | forward | GGTGAGTTTGTTGAGCCATTCTTGG | 270 |
| WNV/PaRV-prME [CA] | KC/PPr_R | reverse | GGATTGTCACTGCTCCCACG | 271 |
| WNV/PaRV-prME [CA] | KC/PPr_F | forward | CGTGGGAGCAGTGACAATCC | 272 |
| WNV/PaRV-prME [CA] | KC/PPr2_R | reverse | ATCAGTAGTGACAACCACTTGGATTGTCACTGCTCCCACGCCAGCAATCAAGCCAATCAT | 273 |
| WNV/PaRV-prME [CA] | KC/PPr2_F | forward | ATGATTGGCTTGATTGCTGGCGTGGGAGCAGTGACAATCCAAGTGGTTGTCACTACTGAT | 274 |
| WNV/PaRV-prME [CA] | K/B(S)-C-SEQ_F | forward | CAGAAGAAGAGAGGAGGAAAGACC | 275 |
| WNV/PaRV-prME [CA] | KUNV-5'UTR_R | reverse | GGCCCTCCTGGTTTCTTAGAC | 276 |
| WNV/PaRV-prME [CA] | KUNV-C-prM_F | forward | GTCTAAGAAACCAGGAGGGCC | 277 |
| WNV/PaRV-prME [CA] | KUNV-UTRlinker_R | reverse | CAGCTCACACAGGCGAACTACT | 278 |
| WNV/PaRV-prME [CA] | KUNV-5'UTR_F | forward | AGTAGTTCGCCTGTGTGAGCTG | 279 |
| WNV/PaRV-prME [CA] | pUC19-R | reverse | TGGATGGCCTTCCCCATTAT | 280 |
| WNV/PaRV-prME [CA] | OplE2-F | forward | CATTATAAGCTGCAATAAACAAGTT | 281 |
| WNV/PaRV-prME [CA] | DNA Linker-F | forward | GGGTCGGCATGGCATCTCC | 282 |
| WNV/PCV-prME [CA] | KUNV-3'UTR_R | reverse | TCCTGTGTTCTCGCACCAC | 283 |
| WNV/PCV-prME [CA] | KUNV-UTRlinker_F | forward | GTGGTGCGAGAACACAGGA | 284 |
| WNV/PCV-prME [CA] | KUN-NS5(only)-R | reverse | TTACAATACTGTATCCTCAACCAATG | 285 |
| WNV/PCV-prME [CA] | KUNV-NS5_R | reverse | CTGTATCCTCAACCAATGTTGTGTCTTC | 286 |
| WNV/PCV-prME [CA] | KUNV-3'UTR_F | forward | GAAGACACAACATTGGTTGAGGATACAG | 287 |
| WNV/PCV-prME [CA] | KUN-NS5(only)-F | forward | GGTGGGGCAAAAGGAC | 288 |
| WNV/PCV-prME [CA] | KUNV-NS4B_R | reverse | CGTCCTTTTGCCCCACCTC | 289 |
| WNV/PCV-prME [CA] | KUNV-NS5_F | forward | GAGGTGGGGCAAAAGGACG | 290 |
| WNV/PCV-prME [CA] | KUNV-NS4A_R | reverse | CCCATCTCATTGGCTGCCAC | 291 |
| WNV/PCV-prME [CA] | KUNV-NS4B_F | forward | GTGGCAGCCAATGAGATGGG | 292 |
| WNV/PCV-prME [CA] | qWNns4A_R | reverse | TAGCTGGTTGTCTGTCTGCG | 293 |
| WNV/PCV-prME [CA] | qWNns4A_F | forward | TTGAGTGTGATGACCATGGGAG | 294 |
| WNV/PCV-prME [CA] | KUNV-NS3_R | reverse | GACCTCGATAAAACCTATTTGAGAGCGC | 295 |
| WNV/PCV-prME [CA] | KUNV-NS4A_F | forward | GCGCTCTCAAATAGGTTTTATCGAGGTC | 296 |
| WNV/PCV-prME [CA] | KUNV-NS2B_R | reverse | CTCCTCTCTTTGTGTATTGGAGAGTTATC | 297 |
| WNV/PCV-prME [CA] | KUNV-NS3_F | forward | GATAACTCTCCAATACACAAAGAGAGGAG | 298 |
| WNV/PCV-prME [CA] | KUNV-NS2A_R | reverse | CTTCAGTTGCAGGCCACCC | 299 |
| WNV/PCV-prME [CA] | KUNV-NS2B_F | forward | GGGTGGCCTGCAACTGAAG | 300 |
| WNV/PCV-prME [CA] | KUNV-NS1_R | reverse | GAAAAGGATCAATCATGTCAGCGTTGTAG | 301 |
| WNV/PCV-prME [CA] | KUNV-NS2A_F | forward | CTACAACGCTGACATGATTGATCCTTTTC | 302 |
| WNV/PCV-prME [CA] | KUN-NS1-INT_R | reverse | CGGTCCATCCAAGCTTCCAC | 303 |
| WNV/PCV-prME [CA] | PCV-E/KUN-NS1_R | reverse | GGCACATCCAGTATCGGCTCGCACAAAATA | 304 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| WNV/PCV-prME [CA] | PCV-E/KUN-NS1_F | forward | TATTTTGTGCGAGCCGATACTGGATGTGCC | 305 |
| WNV/PCV-prME [CA] | PCV-M_R | reverse | CGGTTCCATGTATTCTCCTCGAACCGTTGT | 306 |
| WNV/PCV-prME [CA] | PCV-E_F | forward | ACAACGGTTCGAGGAGAATACATGGAACCG | 307 |
| WNV/PCV-prME [CA] | KUN-C/PCV-Pr_R | reverse | GTCAATCACCACAACTGCTCCCACGCCAGC | 308 |
| WNV/PCV-prME [CA] | KUN-C/PCV-Pr_F | forward | GCTGGCGTGGGAGCAGTTGTGGTGATTGAC | 309 |
| WNV/PCV-prME [CA] | K/B(S)-C-SEQ_F | forward | CAGAAGAAGAGAGGAGGAAAGACC | 310 |
| WNV/PCV-prME [CA] | KUNV-5'UTR_R | reverse | GGCCCTCCTGGTTTCTTAGAC | 311 |
| WNV/PCV-prME [CA] | KUNV-C-prM_F | forward | GTCTAAGAAACCAGGAGGGCC | 312 |
| WNV/PCV-prME [CA] | KUNV-UTRlinker_R | reverse | CAGCTCACACAGGCGAACTACT | 313 |
| WNV/PCV-prME [CA] | KUNV-5'UTR_F | forward | AGTAGTTCGCCTGTGTGAGCTG | 314 |
| WNV/PCV-prME [CA] | pUC19-R | reverse | TGGATGGCCTTCCCCATTAT | 315 |
| WNV/PCV-prME [CA] | OplE2-F | forward | CATTATAAGCTGCAATAAACAAGTT | 316 |
| WNV/PCV-prME [CA] | DNA Linker-F | forward | GGGTCGGCATGGCATCTCC | 317 |
| PCV/DENV2-prME [CA] | PCV 3'-R | reverse | ATGCCATGCCGACCCAGACGTAGCCAAGTA | 318 |
| PCV/DENV2-prME [CA] | PCV CA Linker-F | forward | TACTTGGCTACGTCTGGGTCGGCATGGCAT | 319 |
| PCV/DENV2-prME [CA] | PCV NS5-R | reverse | CATCGTCACACTTCAGTTGAACACAGGATC | 320 |
| PCV/DENV2-prME [CA] | PCV 3'-F | forward | GATCCTGTGTTCAACTGAAGTGTGACGATG | 321 |
| PCV/DENV2-prME [CA] | PCV-NS5-INT_F | forward | CCGTATTTACCCAAAGGAGTGGAC | 322 |
| PCV/DENV2-prME [CA] | PCV NS4B-R | reverse | ACTCTTCACCAGCGAGCGCACGCCCAATCT | 323 |
| PCV/DENV2-prME [CA] | PCV NS5-F | forward | AGATTGGGCGTGCGCTCGCTGGTGAAGAGT | 324 |
| PCV/DENV2-prME [CA] | PCV NS2B-R | reverse | TAGCTCCGAATTTGCCCGCTGGGACATAGC | 325 |
| PCV/DENV2-prME [CA] | PCV NS3-F | forward | GCTATGTCCCAGCGGGCAAATTCGGAGCTA | 326 |
| PCV/DENV2-prME [CA] | DENVE-PCV1_R | reverse | TCCACATCCGAAGTCGGCCTGCACCATAAC | 327 |
| PCV/DENV2-prME [CA] | DENVE-PCV1_F | forward | GTTATGGTGCAGGCCGACTTCGGATGTGGA | 328 |
| PCV/DENV2-prME [CA] | DENV2 M_R | reverse | TGCAGCGCATTGTCATTGAA | 329 |
| PCV/DENV2-prME [CA] | DENV2 E_F | forward | TTCAATGACAATGCGCTGCA | 330 |
| PCV/DENV2-prME [CA] | PCVC-DENVE_R | reverse | TGTGGTCAGATGAAATCCCATAACTCCGAA | 331 |
| PCV/DENV2-prME [CA] | PCVC-DENVE_F | forward | TTCGGAGTTATGGGATTTCATCTGACCACA | 332 |
| PCV/DENV2-prME [CA] | PCV-C-INT_R | reverse | CTCGCTTTTCCTCCTTGCTG | 333 |
| PCV/DENV2-prME [CA] | PCV CA Linker-R | reverse | GCAAAAGTTTTTAAAACTGTTTACCAGATCGTTGC | 334 |
| PCV/DENV2-prME [CA] | PCV CA 5'-F | forward | GCAACGATCTGGTAAACAGTTTTAAAAACTTTTGC | 335 |
| PCV/DENV2-prME [CA] | pUC19-R | reverse | TGGATGGCCTTCCCCATTAT | 336 |
| PCV/DENV2-prME [CA] | OplE2-F | forward | CATTATAAGCTGCAATAAACAAGTT | 337 |
| PCV/DENV2-prME [CA] | DNA Linker-F | forward | GGGTCGGCATGGCATCTCC | 338 |
| PCV/WNV-prME [CA] | PCV 3'-R | reverse | ATGCCATGCCGACCCAGACGTAGCCAAGTA | 339 |
| PCV/WNV-prME [CA] | PCV CA Linker-F | forward | TACTTGGCTACGTCTGGGTCGGCATGGCAT | 340 |
| PCV/WNV-prME [CA] | PCV NS5-R | reverse | CATCGTCACACTTCAGTTGAACACAGGATC | 341 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| PCV/WNV-prME [CA] | PCV 3'-F | forward | GATCCTGTGTTCAACTGAAGTGTGACGATG | 342 |
| PCV/WNV-prME [CA] | PCV-NS5-INT_F | forward | CCGTATTTACCCAAAGGAGTGGAC | 343 |
| PCV/WNV-prME [CA] | PCV NS4B-R | reverse | ACTCTTCACCAGCGAGCGCACGCCCAATCT | 344 |
| PCV/WNV-prME [CA] | PCV NS5-F | forward | AGATTGGGCGTGCGCTCGCTGGTGAAGAGT | 345 |
| PCV/WNV-prME [CA] | PCV NS2B-R | reverse | TAGCTCCGAATTTGCCCGCTGGGACATAGC | 346 |
| PCV/WNV-prME [CA] | PCV NS3-F | forward | GCTATGTCCCAGCGGGCAAATTCGGAGCTA | 347 |
| PCV/WNV-prME [CA] | KUNE-PCV1-R | reverse | TCCACATCCGAAGTCAGCATGCACGTTCAC | 348 |
| PCV/WNV-prME [CA] | KUNE-PCV1-F | forward | GTGAACGTGCATGCTGACTTCGGATGTGGA | 349 |
| PCV/WNV-prME [CA] | KUN-E-Seq-F | forward | GCATGGACCAACTACCG | 350 |
| PCV/WNV-prME [CA] | KUNV-C-prM_R | reverse | GGAAATCTCTGTTGCTCATTCCAAGACAG | 351 |
| PCV/WNV-prME [CA] | KUNV-E_F | forward | CTGTCTTGGAATGAGCAACAGAGATTTCC | 352 |
| PCV/WNV-prME [CA] | PCVC-KUNVpr-R | reverse | GTTGGAGAGAGTGACTCCCATAACTCCGAA | 353 |
| PCV/WNV-prME [CA] | PCVC-KUNVpr-F | forward | TTCGGAGTTATGGGAGTCACTCTCTCCAAC | 354 |
| PCV/WNV-prME [CA] | PCV-C-INT_R | reverse | CTCGCTTTTCCTCCTTGCTG | 355 |
| PCV/WNV-prME [CA] | PCV CA Linker-R | reverse | GCAAAAGTTTTTAAAACTGTTTACCAGATCGTTGC | 356 |
| PCV/WNV-prME [CA] | PCV CA 5'-F | forward | GCAACGATCTGGTAAACAGTTTTAAAAAACTTTTGC | 357 |
| PCV/WNV-prME [CA] | pUC19-R | reverse | TGGATGGCCTTCCCCATTAT | 358 |
| PCV/WNV-prME [CA] | OpIE2-F | forward | CATTATAAGCTGCAATAAACAAGTT | 359 |
| PCV/WNV-prME [CA] | DNA Linker-F | forward | GGGTCGGCATGGCATCTCC | 360 |
| PCV/ZIKV-prME [CA] | PCV 3'-R | reverse | ATGCCATGCCGACCCAGACGTAGCCAAGTA | 361 |
| PCV/ZIKV-prME [CA] | PCV CA Linker-F | forward | TACTTGGCTACGTCTGGGTCGGCATGGCAT | 362 |
| PCV/ZIKV-prME [CA] | PCV NS5-R | reverse | CATCGTCACACTTCAGTTGAACACAGGATC | 363 |
| PCV/ZIKV-prME [CA] | PCV 3'-F | forward | GATCCTGTGTTCAACTGAAGTGTGACGATG | 364 |
| PCV/ZIKV-prME [CA] | PCV-NS5-INT_F | forward | CCGTATTTACCCAAAGGAGTGGAC | 365 |
| PCV/ZIKV-prME [CA] | PCV NS4B-R | reverse | ACTCTTCACCAGCGAGCGCACGCCCAATCT | 366 |
| PCV/ZIKV-prME [CA] | PCV NS5-F | forward | AGATTGGGCGTGCGCTCGCTGGTGAAGAGT | 367 |
| PCV/ZIKV-prME [CA] | PCV NS2B-R | reverse | TAGCTCCGAATTTGCCCGCTGGGACATAGC | 368 |
| PCV/ZIKV-prME [CA] | PCV NS3-F | forward | GCTATGTCCCAGCGGGCAAATTCGGAGCTA | 369 |
| PCV/ZIKV-prME [CA] | ZIKVE-PCV1_R | reverse | TCCACATCCGAAGTCAGCAGAGACGGCTGT | 370 |
| PCV/ZIKV-prME [CA] | ZIKVE-PCV1_F | forward | ACAGCCGTCTCTGCTGACTTCGGATGTGGA | 371 |
| PCV/ZIKV-prME [CA] | Zika M_R | reverse | TGCACCTGATGCTGTATGCC | 372 |
| PCV/ZIKV-prME [CA] | Zika E_F | forward | GGCATACAGCATCAGGTGCA | 373 |
| PCV/ZIKV-prME [CA] | PCVC-ZIKVPr_R | reverse | TCTAGTGACCTCCGCTCCCATAACTCCGAA | 374 |
| PCV/ZIKV-prME [CA] | PCVC-ZIKVPr_F | forward | TTCGGAGTTATGGGAGCGGAGGTCACTAGA | 375 |
| PCV/ZIKV-prME [CA] | PCV-C-INT_R | reverse | CTCGCTTTTCCTCCTTGCTG | 376 |

TABLE 1-continued

Primers used for CPEC amplification to produce chimeric insect-specific flavivirus vectors.

| Sequence Name | Name | Direction | Sequence | SEQ ID NO |
|---|---|---|---|---|
| PCV/ZIKV-prME [CA] | PCV CA Linker-R | reverse | GCAAAAGTTTTTAAAACTGTTTACCAGATCGTTGC | 377 |
| PCV/ZIKV-prME [CA] | PCV CA 5'-F | forward | GCAACGATCTGGTAAACAGTTTTAAAAAACTTTTGC | 378 |
| PCV/ZIKV-prME [CA] | pUC19-R | reverse | TGGATGGCCTTCCCCATTAT | 379 |
| PCV/ZIKV-prME [CA] | OpIE2-F | forward | CATTATAAGCTGCAATAAACAAGTT | 380 |
| PCV/ZIKV-prME [CA] | DNA Linker-F | forward | GGGTCGGCATGGCATCTCC | 381 |

TABLE 2

Binding profiles of a panel of 9 mAbs to epitopes on WNV prM, and all 3 domains of the WNV E protein (including quaternary prM/E epitopes) confirm that PCV/WNV$_{KUN}$-prME and BinJV/WNV$_{KUN}$-prME particles are antigenically identical to WNV in these regions. Data also demonstrates that cross-reactive mAbs to the fusion loop in the EII domain and a quaternary prM/E epitope, fail to bind to BinJV due to a Valine at residue 106 in the wild type virus.

| | Anti-WNV mAb reactivity | | | | | | | | | |
|---|---|---|---|---|---|---|---|---|---|---|
| Virus/mAb | prM + E | prM | EDI | EDII | | | | EDIII | | NS1 |
| target | M2-1E7 | P10F8 | 17D7 | 4G2 | 6B6C1 | P3H8 | 3.91D | 2B2 | 3.67G | 3.1112G |
| WNV | + | + | + | + | + | + | + | + | + | + |
| PCV-WNV$_{STR}$* | + | + | + | + | + | + | + | + | + | − |
| BinJV-WNV$_{STR}$# | + | + | + | + | + | + | + | + | + | − |
| PCV | − | − | − | − | − | − | − | − | − | − |
| BinJV | − | − | − | − | − | − | − | − | − | − |
| BinJV$_{V106G}$ | + | − | − | + | + | + | − | − | − | − |

TABLE 3

Binding profiles of a panel of 5 mAbs to epitopes on ZIKV E protein confirm that PCV/ZIKV-prME particles are antigenically identical to ZIKV in these regions.

| | Anti-ZIKV mAb reactivity | | | | | | |
|---|---|---|---|---|---|---|---|
| Virus/mAb | EDII | | | | EDIII | NS1 | |
| target | 5G12 | 4G2 | 6B6C1 | P3H8 | 4A4 | 3H3 | 2G1 |
| ZIKV | + | + | + | + | + | + | + |
| PCV-ZIKV$_{STR}$* | + | + | + | + | + | − | − |

SEQUENCE LISTING (417 sequences)

SEQ ID NO: 1 - protein, 3460 aa, Artificial Sequence
  Synthetic
MNQERGILRGMGRFPPPPVKKGNKNSVAVARVPPQQGGKAREKNRERIKAPGARHGVAGKMKSLMGELGFGWIDLLRVDLVEGIMMMVFVIQRAFAQVHRRIRGLSRRVRALEKKRDGRAAMFIWTILAMLFGVMGVTLSNFQGKVMMTVNATDVTDIITIPTAAGKNLCIVRAMDVGHMCDDTITYECPVLSAGNDPEDIDCWCTKLAVYVRYGRCTKTRHSRRSRRSLTVQTHGESTLSNKKGAWMDSTKATRYLVKTESWILRNPGYALVAAVIGWMLGSNTMQRVVFAVLLLLVAPAYSFNCLGMSNRDFLEGVSGATWVDLVLEGDSCVTIMSKDKPTIDVKMMNMEAANLAEVRSYCYLATVSELSTKAACPTMGEAHNDKRADPSFVCKQGVVDRGWGNGCGLFGKGSIDTCAKFACSTKATGRTILKENIKYEVAIFVHGPTTVESHGNYFTQTGAAQAGRFSITPAAPSYTLKLGEYGEVTVDCEPRSGIDTSAYYVMTVGTKTFLVHREWFMDLNLPWSSAESNVWRNRETLMEFEEPHATKQSVIALGSQEGALHQALAGAIPVEFSSNTVKLTSGHLKCRVKMEKLQLKGTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSGSSIGKAFTATLKGAQRLAALGDTAWDFGSVGGVFTSVGKAVHQVFGGAFRSLFGGMSWITQGLLGALLLWMGINARDRSIALTFLAVGGVLLFLSVNVHADFGCGFDPDRKVAQCGSGSFVWKSLARWPMADHAIEFEDSKVMVTYLTDLLMRKNKVCIVCEDVLQCAAARGVVEQITSINGIPIHHNMSLSHGRYFPRVVKKVHNVKVGKAMLRLAMATYAGAMPESGLGVLKTGYFSRGEVQETWDDKVLRVLTSAINAEEVCQTAVTFQYEFVRYNRKVFGSNIVLRPSAFTSKACPTYLAGAVVKNDIATFTDGMMWMRSRKVNETWELFELETTQSHQCIWPYAYTIDLATPTDKRLFMPPQYGGPISFANHVPGFQVQEDFPWQKANILMRQGPVPGTTVVQDPHCDDRSAAVPVEPTMQAWCCKTCFDRGVKPFHFVVDGKFFYPMEVRPMKLEQDAVVIETDDGEFERSEHESLFEGKAKWTSPLPMGETAKIQNFFVTSPPKPESSLLLVGVLIHMLTTRTRHRWATRCAGTWLIFLVFGHPVVSSVQSWAWLFMSAALASVPGGSSLVIHFWIGLQISSAHLFYLGWLMRKRLLITEMSRVAHLIAQLCSFETYAWAPILKVLDHLLFPLYTLSVFVVHQQFQVFHDLWLQSAVVMAHLLQHPLSGLITLSLSVGLIQLIAPMKRWFCSPVIWGDGLRAPRPHWTALTYFIVLYLAAAGMETVGLHTSGMTVMLGGMLLWVVLQLMPPTALELVRLPGQSLPDGCEEEASTSLPEGMSGHYAPDGVELVNYTDAGTVSANLVVFVGCAGIMTMNIYVGLVITALAWVTDAPMWIPRLIDGAMSQRANSELLLPSPPLEIHKTEDSFGYIPDGTYHVLASSWMSKKPVGVGVVKEGVFHTLHHVTKGANVTWAGREVRMHSGDVRRDIAAYGGPWNISGSLEDVVVVKAVNKDGTVTCCRITTAKLDIEGTTVMAVERDFGFGSSGSPIYAPDGRLIGLYGYGFYYGTYFSIVSTGEGVEAPPEEVEVSTREFVDWHPGRGKTRTILVEQALKHIADGKRLLILTPTRVVKDEVQRAIKEAAPQAVIGSNLSIFRKNAVTLACHATFTQYVMEKGIESVKFSTIIMDECHFLDPMSIACRGIMDFHNSRGTKVIFMSATPPGRAGNAGSNFTIEDRAIKFPKELTASWIKDKSIGKTIVFVPTITQAVRLAKELGGVALTRDTFNDAMGKARSPETMFIISTDISEMGANLGVTTVIDTRTVIKPLVSDKGVSLERVGVTPASIIQRRGRVGRREPGVYIYPLDVEPEEQPENWVCWVEAQMILDQLGCHPMREESEFFRPQGTYRIDDVEQRRFLGLIKEKLPIWLAWTWASSHANKHQMLFQGNAPNTGRTLKIKTPSGSHIYAPKVTDDRFEKEPEIVKVAAIGFFLKQRSLYFDLPGLLTGLYTVLTTAGLDALGNSFKRSVDTLHDIGNAVEGEFSAIQMGRILQMWSALFIGVTLGVVLMGAGFVVVKAFRGLFGTRQQHTTVCVSEGGSFQKVATVLMSVGPLCAVFGGIPSIFVFIVTVALLIVLCVGGGGSQRGVLDSDLIRWVMVLAMMTIGVTAWELELLPNVRRDVIQLTRYLFASNPAVVGAVFNAGNIGLGVSLPGTLMMSYAASGTLAPLIGAWAEGNFLGKLFGSEVLPAQAIGGFQVTAIPWGSMVPVIAGCFLATNTLSKVFGAGITTVFLILLYFDKKHAFTNKAVKVLLARTNRRDMEEEITTRDAESRARQLFYGLQLAVSLLWVLSHPVLENFVPFFAVCGYTFLSLLRPNHQLHAALDYTLVVLLLQVVEPGNIMYVGGCVLLWYVLNPTRLGVRSLVKSDTGGLGFRWKKALNSLSERQFAIYKVRGVNETDKGAYVSRGGLKMNEIINKHAWEPRGVVVDLGCGRGGWSQRLVMDYRVAEVRGYTLGGKERENPQPFQTKGYNLANLKAGVDVYKMEPVNCNTIICDIGESDPRPEVEKTRTLKVLGMLEKWLEVNPNASFCCKVLSPYHLDVLRKLESLQHKYNGRLVRLSYSRNSTAEMYYVSGKRANVVASVYFMLGSLVGRLRRHEPSIIDPPPVLEMGTRSDPRAKAKAQDFEMIRRRVERLRGENRKTWFVDNEHPYVSFNYHGSFVTDEVTAGGQTTNPLIRRVMWPWDFLSRVTTFMMTDVSTYAQQKVLREKVDTVSEEPDERMKAINRLIMTHFVKMFKRRGLKPRVLTPQDYMNNVQANAAIGGWSEVMDWQNVRDALADQRFWDMVDNERALHLRGDCELCIYNTMGKKEKKPSAFGTAKGSRTIWYMWLGSRYLEYEALGFLNEDHWVARENFPCGVGGVGVNYFGYYLKEIAGGGRWLIADDVAGWDTRITQGDLDDELFMLTELAPTTYHKKLITATMTLAYKNIVALFPRNHPMYRSGTVLDVLSRTDQRGSGQVTTYALNTVTNGKCQVGRTLEACGLLDAPLTTIDSWLTANLERVLGAMVVAGDDVVVATDNEEFHTSLRYITATSKIRKNLGVSEPSPRFTSWEDVEFCSHHFHPLTLRDGRVLIAPCRDQNEIIGRSRIQKGGIVDMASAGCLAKAHAQMWALYFFHRRDLRIGFAAITSIVPINWVPTGRISWSIHQNAEWMTTEDMLTVWNNVWIRDNPWMRGKERVTSWTDIPYLPKGVDIKCGSLIGDSDRASWSKTIPLVVEKTRKILEQERGTLKFYNGLSILGRYVHHVDPVFN

SEQ ID NO: 2 - protein, 3464 aa, Artificial Sequence
  Synthetic
MNQERGILRGMGRFPPPPVKKGNKNSVAVARVPPQQGGKAREKNRERIKAPGARHGVAGKMKSLMGELGFGWIDLLRVDLVEGIMMMVFVIQRAFAQVHRRIRGLSRRVRALEKKRDGRAAMFIWTILAMLFGVMGAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADFGCGFDPDRKVAQCGSGSFVWKSLARWPMADHAIEFEDSKVMVTYLTDLLMRKNKVCIVCEDVLQCAAARGVVEQITSINGIPIHHNMSLSHGRYFPRVVKKVHNVKVGKAMLRLAMATYAGAMPESGLGVLKTGYFSRGEVQETWDDKVLRVLTSAINAEEVCQTAVTFQYEFVRYNRKVFGSNIVLRPSAFTSKACPTYLAGAVVKNDIATFTDGMMWMRSRKVNETWELFELETTQSHQCIWPYAYTIDLATPTDKRLFMPPQYGGPISFANHVPGFQVQEDFPWQKANILMRQGPVPGTTVVQDPHCDDRSAAVPVEPTMQAWCCKTCFDRGVKPFHFVVDGKFFYPMEVRPMKLEQDAVVIETDDGEFERSEHESLFEGKAKWTSPLPMGETAKIQNFFVTSPPKPESSLLLVGVLIHMLTTRTRHRWATRCAGTWLIFLVFGHPVVSSVQSWAWLFMSAALASVPGGSSLVIHFWIGLQISSAHLFYLGWLMRKRLLITEMSRVAHLIAQLCSFETYAWAPILKVLDHLLFPLYTLSVFVVHQQFQVFHDLWLQSAVVMAHLLQHPLSGLITLSLSVGLIQLIAPMKRWFCSPVIWGDGLRAPRPHWTALTYFIVLYLAAAGMETVGLHTSGMTVMLGGMLLWVVLQLMPPTALELVRLPGQSLPDGCEEEASTSLPEGMSGHYAPDGVELVNYTDAGTVSANLVVFVGCAGIMTMNIYVGLVITALAWVTDAPMWIPRLIDGAMSQRANSELLLPSPPLEIHKTEDSFGYIPDGTYHVLASSWMSKKPVGVGVVKEGVFHTLHHVTKGANVTWAGREVRMHSGDVRRDIAAYGGPWNISGSLEDVVVVKAVNKDGTVTCCRITTAKLDIEGTTVMAVERDFGFGSSGSPIYAPDGRLIGLYGYGFYYGTYFSIVSTGEGVEAPPEEVEVSTREFVDWHPGRGKTRTILVEQALKHIADGKRLLILTPTRVVKDEVQRAIKEAAPQAVIGSNLSIFRKNAVTLACHATFTQYVMEKGIESVKFSTIIMDECHFLDPMSIACRGIMDFHNSRGTKVIFMSATPPGRAGNAGSNFTIEDRAIKFPKELTASWIKDKSIGKTIVFVPTITQAVRLAKELGGVALTRDTFNDAMGKARSPETMFIISTDISEMGANLGVTTVIDTRTVIKPLVSDKGVSLERVGVTPASIIQRRGRVGRREPGVYIYPLDVEPEEQPENWVCWVEAQMILDQLGCHPMREESEFFRPQGTYRIDDVEQRRFLGLIKEKLPIWLAWTWASSHANKHQMLFQGNAPNTGRTLKIKTPSGSHIYAPKVTDDRFEKEPEIVKVAAIGFFLKQRSLYFDLPGLLTGLYTVLTTAGLDALGNSFKRSVDTLHDIGNAVEGEFSAIQMGRILQMWSALFIGVTLGVVLMGAGFVVVKAFRGLFGTRQQHTTVCVSEGGSFQKVATVLMSVGPLCAVFGGIPSIFVFIVTVALLIVLCVGGGGSQRGVLDSDLIRWVMVLAMMTIGVTAWELELLPNVRRDVIQLTRYLFASNPAVVGAVFNAGNIGLGVSLPGTLMMSYAASGTLAPLIGAWAEGNFLGKLFGSEVLPAQAIGGFQVTAIPWGSMVPVIAGCFLATNTLSKVFGAGITTVFLILLYFDKKHAFTNKAVKVLLARTNRRDMEEEITTRDAESRARQLFYGLQLAVSLLWVLSHPVLENFVPFFAVCGYTFLSLLRPNHQLHAALDYTLVVLLLQVVEPGNIMYVGGCVLLWYVLNPTRLGVRSLVKSDTGGLGFRWKKALNSLSERQFAIYKVRGVNETDKGAYVSRGGLKMNEIINKHAWEPRGVVVDLGCGRGGWSQRLVMDYRVAEVRGYTLGGKERENPQPFQTKGYNLANLKAGVDVYKMEPVNCNTIICDIGESDPRPEVEKTRTLKVLGMLEKWLEVNPNASFCCKVLSPYHLDVLRKLESLQHKYNGRLVRLSYSRNSTAEMYYVSGKRANVVASVYFMLGSLVGRLRRHEPSIIDPPPVLEMGTRSDPRAKAKAQDFEMIRRRVERLRGENRKTWFVDNEHPYVSFNYHGSFVTDEVTAGGQTTNPLIRRVMWPWDFLSRVTTFMMTDVSTYAQQKVLREKVDTVSEEPDERMKAINRLIMTHFVKMFKRRGLKPRVLTPQDYMNNVQANAAIGGWSEVMDWQNVRDALADQRFWDMVDNERALHLRGDCELCIYNTMGKKEKKPSAFGTAKGSRTIWYMWLGSRYLEYEALGFLNEDHWVARENFPCGVGGVGVNYFGYYLKEIAGGGRWLIADDVAGWDTRITQGDLDDELFMLTELAPTTYHKKLITATMTLAYKNIVALFPRNHPMYRSGTVLDVLSRTDQRGSGQVTTYALNTVTNGKCQVGRTLEACGLLDAPLTTIDSWLTANLERVLGAMVVAGDDVVVATDNEEFHTSLRYITATSKIRKNLGVSEPSPRFTSWEDVEFCSHHFHPLTLRDGRVLIAPCRDQNEIIGRSRIQKGGIVDMASAGCLAKAHAQMWALYFFHRRDLRIGFAAITSIVPINWVPTGRISWSIHQNAEWMTTEDMLTVWNNVWIRDNPWMRGKERVTSWTDIPYLPKGVDIKCGSLIGDSDRASWSKTIPLVVEKTRKILEQERGTLKFYNGLSILGRYVHHVDPVFN

SEQ ID NO: 3 - protein, 3453 aa, Artificial Sequence
  synthetic
MNQERGILRGMGRFPPPPVKKGNKNSVAVARVPPQQGGKAREKNRERIKAPGARHGVAGKMKSLMGELGFGWIDLLRVDLVEGIMMMVFVIQRAFAQVHRRIRGLSRRVRALEKKRDGRAAMFIWTILAMLFGVMGFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMKDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADFGCGFDPDRKVAQCGSGSFVWKSLARWPMADHAIEFEDSKVMVTYLTDLLMRKNKVCIVCEDVLQCAAARGVVEQITSINGIPIHHNMSLSHGRYFPRVVKKVHNVKVGKAMLRLAMATYAGAMPESGLGVLKTGYFSRGEVQETWDDKVLRVLTSAINAEEVCQTAVTFQYEFVRYNRKVFGSNIVLRPSAFTSKACPTYLAGAVVKNDIATFTDGMMWMRSRKVNETWELFELETTQSHQCIWPYAYTIDLATPTDKRLFMPPQYGGPISFANHVPGFQVQEDFPWQKANILMRQGPVPGTTVVQDPHCDDRSAAVPVEPTMQAWCCKTCFDRGVKPFHFVVDGKFFYPMEVRPMKLEQDAVVIETDDGEFERSEHESLFEGKAKWTSPLPMGETAKIQNFFVTSPPKPESSLLLVGVLIHMLTTRTRHRWATRCAGTWLIFLVFGHPVVSSVQSWAWLFMSAALASVPGGSSLVIHFWIGLQISSAHLFYLGWLMRKRLLITEMSRVAHLIAQLCSFETYAWAPILKVLDHLLFPLYTLSVFVVHQQFQVFHDLWLQSAVVMAHLLQHPLSGLITLSLSVGLIQLIAPMKRWFCSPVIWGDGLRAPRPHWTALTYFIVLYLAAAGMETVGLHTSGMTVMLGGMLLWVVLQLMPPTALELVRLPGQSLPDGCEEEASTSLPEGMSGHYAPDGVELVNYTDAGTVSANLVVFVGCAGIMTMNIYVGLVITALAWVTDAPMWIPRLIDGAMSQRANSELLLPSPPLEIHKTEDSFGYIPDGTYHVLASSWMSKKPVGVGVVKEGVFHTLHHVTKGANVTWAGREVRMHSGDVRRDIAAYGGPWNISGSLEDVVVVKAVNKDGTVTCCRITTAKLDIEGTTVMAVERDFGFGSSGSPIYAPDGRLIGLYGYGFYYGTYFSIVSTGEGVEAPPEEVEVSTREFVDWHPGRGKTRTILVEQALKHIADGKRLLILTPTRVVKDEVQRAIKEAAPQAVIGSNLSIFRKNAVTLACHATFTQYVMEKGIESVKFSTIIMDECHFLDPMSIACRGIMDFHNSRGTKVIFMSATPPGRAGNAGSNFTIEDRAIKFPKELTASWIKDKSIGKTIVFVPTITQAVRLAKELGGVALTRDTFNDAMGKARSPETMFIISTDISEMGANLGVTTVIDTRTVIKPLVSDKGVSLERVGVTPASIIQRRGRVGRREPGVYIYPLDVEPEEQPENWVCWVEAQMILDQLGCHPMREESEFFRPQGTYRIDDVEQRRFLGLIKEKLPIWLAWTWASSHANKHQMLFQGNAPNTGRTLKIKTPSGSHIYAPKVTDDRFEKEPEIVKVAAIGFFLKQRSLYFDLPGLLTGLYTVLTTAGLDALGNSFKRSVDTLHDIGNAVEGEFSAIQMGRILQMWSALFIGVTLGVVLMGAGFVVVKAFRGLFGTRQQHTTVCVSEGGSFQKVATVLMSVGPLCAVFGGIPSIFVFIVTVALLIVLCVGGGGSQRGVLDSDLIRWVMVLAMMTIGVTAWELELLPNVRRDVIQLTRYLFASNPAVVGAVFNAGNIGLGVSLPGTLMMSYAASGTLAPLIGAWAEGNFLGKLFGSEVLPAQAIGGFQVTAIPWGSMVPVIAGCFLATNTLSKVFGAGITTVFLILLYFDKKHAFTNKAVKVLLARTNRRDMEEEITTRDAESRARQLFYGLQLAVSLLWVLSHPVLENFVPFFAVCGYTFLSLLRPNHQLHAALDYTLVVLLLQVVEPGNIMYVGGCVLLWYVLNPTRLGVRSLVKSDTGGLGFRWKKALNSLSERQFAIYKVRGVNETDKGAYVSRGGLKMNEIINKHAWEPRGVVVDLGCGRGGWSQRLVMDYRVAEVRGYTLGGKERENPQPFQTKGYNLANLKAGVDVYKMEPVNCNTIICDIGESDPRPEVEKTRTLKVLGMLEKWLEVNPNASFCCKVLSPYHLDVLRKLESLQHKYNGRLVRLSYSRNSTAEMYYVSGKRANVVASVYFMLGSLVGRLRRHEPSIIDPPPVLEMGTRSDPRAKAKAQDFEMIRRRVERLRGENRKTWFVDNEHPYVSFNYHGSFVTDEVTAGGQTTNPLIRRVMWPWDFLSRVTTFMMTDVSTYAQQKVLREKVDTVSEEPDERMKAINRLIMTHFVKMFKRRGLKPRVLTPQDYMNNVQANAAIGGWSEVMDWQNVRDALADQRFWDMVDNERALHLRGDCELCIYNTMGKKEKKPSAFGTAKGSRTIWYMWLGSRYLEYEALGFLNEDHWVARENFPCGVGGVGVNYFGYYLKEIAGGGRWLIADDVAGWDTRITQGDLDDELFMLTELAPTTYHKKLITATMTLAYKNIVALFPRNHPMYRSGTVLDVLSRTDQRGSGQVTTYALNTVTNGKCQVGRTLEACGLLDAPLTTIDSWLTANLERVLGAMVVAGDDVVVATDNEEFHTSLRYITATSKIRKNLGVSEPSPRFTSWEDVEFCSHHFHPLTLRDGRVLIAPCRDQNEIIGRSRIQKGGIVDMASAGCLAKAHAQMWALYFFHRRDLRIGFAAITSIVPINWVPTGRISWSIHQNAEWMTTEDMLTVWNNVWIRDNPWMRGKERVTSWTDIPYLPKGVDIKCGSLIGDSDRASWSKTIPLVVEKTRKILEQERGTLKFYNGLSILGRYVHHVDPVFN

SEQ ID NO: 4 - protein, 3411 aa, Artificial Sequence
  Synthetic
MSNPSVRRGVNVMAAQKKRVAQKIKSMRKGTQSISNGVRGFILFFISQIFWARKITPRVKGLWKKLDKFQAMKVLKGLRNIINGLMRSVAGKKKRRGGNTVPFLVMMMVATTWAVTLSNFQGKVMMTVNATDVTDIITIPTAAGKNLCIVRAMDVGHMCDDTITYECPVLSAGNDPEDIDCWCTKLAVYVRYGRCTKTRHSRRSRRSLTVQTHGESTLSNKKGAWMDSTKATRYLVKTESWILRNPGYALVAAVIGWMLGSNTMQRVVFAVLLLLVAPAYSFNCLGMSNRDFLEGVSGATWVDLVLEGDSCVTIMSKDKPTIDVKMMNMEAANLAEVRSYCYLATVSELSTKAACPTMGEAHNDKRADPSFVCKQGVVDRGWGNGCGLFGKGSIDTCAKFACSTKATGRTILKENIKYEVAIFVHGPTTVESHGNYFTQTGAAQAGRFSITPAAPSYTLKLGEYGEVTVDCEPRSGIDTSAYYVMTVGTKTFLVHREWFMDLNLPWSSAESNVWRNRETLMEFEEPHATKQSVIALGSQEGALHQALAGAIPVEFSSNTVKLTSGHLKCRVKMEKLQLKGTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSGSSIGKAFTATLKGAQRLAALGDTAWDFGSVGGVFTSVGKAVHQVFGGAFRSLFGGMSWITQGLLGALLLWMGINARDRSIALTFLAVGGVLLFLSVNVHAEYGCSLDFQRKELKCGDGVFVFNDANDWLTKYRYHPEDPRTLASLVKASYKAGRCGLGSVDNMEHKMWVSLENELNAIFEENQENISVVVKESNGIYPKGNYPFTGTPEKLKYGWKTWGKKLVFAPVLSNNTFVIDGTPDDCPYSNRVWNSFEIDEFGAGLTHTRVFLKQRLERKEECDNALLGAAAKGDVAVHGDPNFWMASNKTGEVWQINELMSLNLKHCTWPLSHTLHGNGVLESDMFVPKSIGGPVSHHNFIKGYKSQVNGPWASVPLEMHRRECPDTVVQIDQNCSGRGKSTRSTTKEGKIIRDWCCRNCTLPPVSFDGPDGCWYAMEIRPQKMNEKHLVTSWVSAGDGMENGNIGLVALFVCFDMFLKNKNTRKISLVGALCLLGAMILGNVGFVDLIKFMIVVGEHFRSFNHGGDVSYLVLTAVFDIRPALLCGFVLRKKWSPSERVVMAIGMMLLQTVCGDWTQTSWWEWLDAVGLGLLILNAVALQRWKPAILVLLTMLTPLNMRVIQGAAGGVCGVMVAMSLWKTEGRSLRKSYLPVIGYVASAFGWGYSWIMAVYIMWATHVSRRSWPVGELAAAIGLLGAAMGMASTKDGAMVMPIAVLGLIMVIIGMTGKCDGMEIRKVGCVSWEDSAEISGSSSRYDVALSDGGEFQLLENSRPPWNHIIFLTLGMLASAVHPIVLGVVILAWGWFAGKSQRSGVLWDVPVAPKVEDHGPLEDGIYTIFQNGLFGSSQAGVGVAQGGVFHTMWHVTRGGILLHKGKRLTPGWASVKSDLISYGGKWRLDGSWDGVEEVQLIAVPPRKNPINVQTKPSIFKLKSGEEMGAIALDYPSGTSGSPIVNRAGVVVGLYGNGIVLNQGGYVSAISQAAVEEVSRDELPGIEGYLRKGQLTVLDFHPGAGKTRNFLPQILKACRTRKLRTLVLAPTRVVLSEMKEALNDHDVKYHTQAFSSASSGRELIDAMCHATLAYRLLESTRVINWEVVIMDEAHYMDPASIAVRGWAAHRARAHECATIFMSATPPGTANEFPESNGGIEDIRKDIPSEAWNKGHEWILEDRRPTVWFLPSIRSANNIAACLRKANRTVVVLNRQTFESVYPTIKTKKPDFILATDIAEMGANLHVERVIDCRTAFKPVLSEDQERVTLKGPMRISASAAAQRRGRVGRDPSRESDTYYYGEDTSEDNDHLVCWTEASMILDNMEIKGGMVAPLYSVEATKTKMTPGECRLRDDQRKTFRALIKKHELPVWVSWKVAKAGITPDDRKWCFDGEEDNTVLNDMGEKVMGRSPGGAKKALCPRWSDARLTSDNASLMNFLAFAEGRRSYMRIVDALIMVPPMLKEKVVDAADTLALLLRSEEGSRAYKLAQESAPEAITTLIMVTFLVLLSAGLVLMLMWPKGISKMSLGMLTMSVAGYLLLEGGLTQVQVAGILLVFFILMVVLIPDDGSQRSINDNKLAYMMTGIILLVGAVAANEMGWLEKTKQDLFGKREEMPGWNWDLGLDLRPGAAWTTYVALATVLGPVIDHWIQVEYGSASLTGIANSAGISAFLDKGVPFMKVNMAVVVLFVSAWNSYSMLAIMEGCLMAGIHFCLLIPGLKARAMKKAQKRIYHGLSKNPVVDGTPTVDIEEAEETPVLYEKKVALALLGVVAALNGIVVRTPFSMAESIVLGSALVGPFIEGNTSPLWNAPIAVAFAGLMRGHYSSMIGLAYNFWILQNPKRGGGETMTLGQVWKKRLNMLDKKEFAKYKISDIHEVDRRQARTILDAGITNVGVSVSRGTSKLKWLTDRGYFKPEGRVVDLGCGRGGWSYLAAAARETLEVKAYTLGVSGHERPIQIQSLGWNVIKFKDRVDVHRLPIAQCDTVMCDIGESSSSWEQERERTLRVIDLMENWVAKSRPKYCFKVLAPYSSEVIERLELFQRRFGGGIIRVPLSRNSTHEMYYTSEVTNNIVHMVNCVSRLLLRRMTNPSGIAILEPDVVFPTGTRNVKGDLGPLDMEKIKMRVSKLKKENLDTWWHDENHPYRTWHYLGSYVAKQSGSAATMVNGIVKLLSMPWDRIEDVTALAMTDTTPYGQQRVFKEKVDTRAPPPPPGTRKIMSITNTWLFDFLGRSKQPRLCTKAEFIAKVRSHAAIGNMLEEQEGWKNAAEAVNDPRFWELVSEERELHLQGKCSTCIYNMMGKREKKPAEFGRAKGSRAIWYMWLGARFLEFEALGFLNEDHWFSRDNSKGGVEGMGLQYLGYVVEDVWKKGNGIMYADDTAGWDTRITEADLEDEQYLLEKMSGTHKKLAWAITELTYKNKVVKVPRPGPGGKILMDVIARRDQRGSGQVVTYPLNTGTNLKTQLIRMAEGEGIITPEDTLQLSHKNEKNLREWLCTHGAERLGRMAVSGDDCIVAPIDERFGNALSHLNAMSKIRKDIDDWEPSKPWMKWEEVPFCSHHFHHLLLKDGRRIIVPCRNQDELIGRARVSPGNGWMIKETACHSKSYGQMWLLMYFHRRDLRLMANAISSCVPINWVPTGRTTWSLHAGGEWMTSEDMLEVWNRVWILDNPHMSDKSVILEWRDVPYLAKSDDIRCGSLIGTSQRACWAANIRSVVEKIRHLVGDEKYKDYLHSMDRYALEHSEIGCLI

SEQ ID NO: 5 - protein, 3364 aa, Palm Creek virus
MNQERGILRGMGRFPPPPVKKGNKNSVAVARVPPQQGGKAREKNRERIKAPGARHGVAGKMKSLMGELGFGWIDLLRVDLVEGIMMMVFVIQRAFAQVHRRIRGLSRRVRALEKKRDGRAAMFIWTILAMLFGVMGVVVIDMRVTYDGQVQIYRDGENMTDRVALFKLPTDGCSVGLPVSKMCHKVDKNMKEGLADTDCGSTWAEFRLRYQRCQVKTRAKRVAPDGPKQDFLAEVEIVAFKAIRENKSVLLVVVLCVAIAKRWPLWVLILLSIGTWTTVRGEYMEPLYVLKADQMTMIQTTLRPEEGYVTATANGLFEMKTGRAFIYGSQVVKTLVTDCEVNATYSTDICPGGSQLSMQDIQAEGRACASEPYNRGWGTGCFKWGVGFVATCAEVDCTTSVKVSSVARSTIKMNVTATYHSVKSVQSVISDVPVTFQFGQLGIASMTCRLESDRIAQSYYHVEGNKKEGLFMKEQIDGWNGATLAAGKIANTEKIVIWGDVKPNEILVKAVSEPQLEWTNAIATHDGFRDVGFVCQIMLDKLVTGVFKDCKTPKTSTFTQSGFGFDGIITTTLAVAQTEACSISISCKGCTLLATKAVFSAGDIESKTWVRCGNESGTAIVGGQEVAVACATNPITQGWRLVKHATQRYRKFGMPGVGGVFHDLVGTLNPWSFFSTTTLVFMAVVLFIVDKRILILGIACYMFYFVRADFGCGFDPDRKVAQCGSGSFVWKSLARWPMADHAIEFEDSKVMVTYLTDLLMRKNKVCIVCEDVLQCAAARGVVEQITSINGIPIHHNMSLSHGRYFPRVVKKVHNVKVGKAMLRLAMATYAGAMPESGLGVLKTGYFSRGEVQETWDDKVLRVLTSAINAEEVCQTAVTFQYEFVRYNRKVFGSNIVLRPSAFTSKACPTYLAGAVVKNDIATFTDGMMWMRSRKVNETWELFELETTQSHQCIWPYAYTIDLATPTDKRLFMPPQYGGPISFANHVPGFQVQEDFPWQKANILMRQGPVPGTTVVQDPHCDDRSAAVPVEPTMQAWCCKTCFDRGVKPFHFVVDGKFFYPMEVRPMKLEQDAVVIETDDGEFERSEHESLFEGKAKWTSPLPMGETAKIQNFFVTSPPKPESSLLLVGVLIHMLTTRTRHRWATRCAGTWLIFLVFGHPVVSSVQSWAWLFMSAALASVPGGSSLVIHFWIGLQISSAHLFYLGWLMRKRLLITEMSRVAHLIAQLCSFETYAWAPILKVLDHLLFPLYTLSVFVVHQQFQVFHDLWLQSAVVMAHLLQHPLSGLITLSLSVGLIQLIAPMKRWFCSPVIWGDGLRAPRPHWTALTYFIVLYLAAAGMETVGLHTSGMTVMLGGMLLWVVLQLMPPTALELVRLPGQSLPDGCEEEASTSLPEGMSGHYAPDGVELVNYTDAGTVSANLVVFVGCAGIMTMNIYVGLVITALAWVTDAPMWIPRLIDGAMSQRANSELLLPSPPLEIHKTEDSFGYIPDGTYHVLASSWMSKKPVGVGVVKEGVFHTLHHVTKGANVTWAGREVRMHSGDVRRDIAAYGGPWNISGSLEDVVVVKAVNKDGTVTCCRITTAKLDIEGTTVMAVERDFGFGSSGSPIYAPDGRLIGLYGYGFYYGTYFSIVSTGEGVEAPPEEVEVSTREFVDWHPGRGKTRTILVEQALKHIADGKRLLILTPTRVVKDEVQRAIKEAAPQAVIGSNLSIFRKNAVTLACHATFTQYVMEKGIESVKFSTIIMDECHFLDPMSIACRGIMDFHNSRGTKVIFMSATPPGRAGNAGSNFTIEDRAIKFPKELTASWIKDKSIGKTIVFVPTITQAVRLAKELGGVALTRDTFNDAMGKARSPETMFIISTDISEMGANLGVTTVIDTRTVIKPLVSDKGVSLERVGVTPASIIQRRGRVGRREPGVYIYPLDVEPEEQPENWVCWVEAQMILDQLGCHPMREESEFFRPQGTYRIDDVEQRRFLGLIKEKLPIWLAWTWASSHANKHQMLFQGNAPNTGRTLKIKTPSGSHIYAPKVTDDRFEKEPEIVKVAAIGFFLKQRSLYFDLPGLLTGLYTVLTTAGLDALGNSFKRSVDTLHDIGNAVEGEFSAIQMGRILQMWSALFIGVTLGVVLMGAGFVVVKAFRGLFGTRQQHTTVCVSEGGSFQKVATVLMSVGPLCAVFGGIPSIFVFIVTVALLIVLCVGGGGSQRGVLDSDLIRWVMVLAMMTIGVTAWELELLPNVRRDVIQLTRYLFASNPAVVGAVFNAGNIGLGVSLPGTLMMSYAASGTLAPLIGAWAEGNFLGKLFGSEVLPAQAIGGFQVTAIPWGSMVPVIAGCFLATNTLSKVFGAGITTVFLILLYFDKKHAFTNKAVKVLLARTNRRDMEEEITTRDAESRARQLFYGLQLAVSLLWVLSHPVLENFVPFFAVCGYTFLSLLRPNHQLHAALDYTLVVLLLQVVEPGNIMYVGGCVLLWYVLNPTRLGVRSLVKSDTGGLGFRWKKALNSLSERQFAIYKVRGVNETDKGAYVSRGGLKMNEIINKHAWEPRGVVVDLGCGRGGWSQRLVMDYRVAEVRGYTLGGKERENPQPFQTKGYNLANLKAGVDVYKMEPVNCNTIICDIGESDPRPEVEKTRTLKVLGMLEKWLEVNPNASFCCKVLSPYHLDVLRKLESLQHKYNGRLVRLSYSRNSTAEMYYVSGKRANVVASVYFMLGSLVGRLRRHEPSIIDPPPVLEMGTRSDPRAKAKAQDFEMIRRRVERLRGENRKTWFVDNEHPYVSFNYHGSFVTDEVTAGGQTTNPLIRRVMWPWDFLSRVTTFMMTDVSTYAQQKVLREKVDTVSEEPDERMKAINRLIMTHFVKMFKRRGLKPRVLTPQDYMNNVQANAAIGGWSEVMDWQNVRDALADQRFWDMVDNERALHLRGDCELCIYNTMGKKEKKPSAFGTAKGSRTIWYMWLGSRYLEYEALGFLNEDHWVARENFPCGVGGVGVNYFGYYLKEIAGGGRWLIADDVAGWDTRITQGDLDDELFMLTELAPTTYHKKLITATMTLAYKNIVALFPRNHPMYRSGTVLDVLSRTDQRGSGQVTTYALNTVTNGKCQVGRTLEACGLLDAPLTTIDSWLTANLERVLGAMVVAGDDVVVATDNEEFHTSLRYITATSKIRKNLGVSEPSPRFTSWEDVEFCSHHFHPLTLRDGRVLIAPCRDQNEIIGRSRIQKGGIVDMASAGCLAKAHAQMWALYFFHRRDLRIGFAAITSIVPINWVPTGRISWSIHQNAEWMTTEDMLTVWNNVWIRDNPWMRGKERVTSWTDIPYLPKGVDIKCGSLIGDSDRASWSKTIPLVVEKTRKILEQERGTLKFYNGLSILGRYVHHVDPVFN

SEQ ID NO: 6 - protein, 3433 aa, Binjari virus
MVTKLRRPVKRAVDMMRRAVPRAAGPRRVLTRVSNTVKRNAGALRALLAYLLYQTFSGRKVGSGARSALKRFNKNDIVKMLLAFRRTLTNIITTMQRRVKGKKRRGVQDVPLLVLLLVGAGAMAATLRTVGDLTWLNVSTTDVGKWIRVENRHGKGECFVTATDVGTWCSDSVGYECPQIAPAYDPEDLDCYCRNTSTYVTYGRCKNGRSGRSRSKRAITIAPHGEAGLRVGSTKHWTSRATPQRYLMRVEKWVLRHPLPALVLVVLGWMMGRSHGQRAMYIVLMLLVAPSYGNQCLDVQSRDFVQGVSGGTWVDVVLDHDNCITIVADGKPSFDIRLSKMSMSKFAEYKRYCLQATMSDVTSIVACPGAGDAHNDKSKNHEYICKAVNNDRGWGNGCVLFGKGSMETCGKFECKKKMAGKLVARENVESVVTVHVHGASATDTKGVDTASTAKATITPKASVATLNLNDFGSLEVDCSTDVGMDFGEIVVADMSGKWWIVNKDWFNELALPWSTASTTAEVWQARDRLVEFGWPHAAKQNIYDIGDQEGAVTAAIAQAPMAKWESDKVELISGILKCKVKLGNLKLRGVTYSMCAQTFTTETRPADTGHGTVAFKVKYVGTDVPCRVPLHIIDSDGGVAAGRVITAHPFVMKQNDYIILEVEPPFGDSKIEIGTGTTKLVEAWHRKGSSIGNAFTATYKGITKLTVLGEHAWDFNSLGGFGASLGKAVHTLFGGVFRVMFGGMGWLTKIFVGAVLVWLGLGAHDKTIATTMILVGSILMYMAVTVGALSEIGCSLDISRKEMKCGDGVFIFREAGMWKDGYAFHPSEPKSLAASVLKSWQSGVCGVRSTNRMEHAMWKQIENELNGILEENEAQLSVVVRESNGTFPRGERRMHVAEPLRYGWKTWGKTAISTVPLAKETFVVDGNDEGECPSQMRAWNSFQVEEFGTGLVKTKVFLDISTALTAQCDTKMLGAAIKGNRSVHGDPGLWMVSAEIDGTWQIIELTLAESRRCTWPDSHTVWGRNVQESELILPPSFGGPMTNMNKRKGYATQVGGPWNHVPLRVVFEECPGTTVSVEPNCTRRSDSVRSTTDSGKIITDWCCRSCTMPPLTYRTPDGCWYAMEIRPKNVKEESLIRSHVAAGVFKGIDDVSLGLLVMIIFLQEGLRRKLTATYIMWAALVVLIAGILGELTVRDVLRYLILVGTAFAESNNGGDLIHLALVAVFKIRPAFLFGFLFRSQWSPREGVLLASGALMLQIASECLHASAIMQVVDSLSMGWLMIRAIAVPGMTSKAMPLLCACIPAVTSLLAHSTRAGIITMAGMSLIAGSKGSSVKKHSPYMLALVVAGLGARPIGMLAMEAFSHLKGRRSWPAGEMMSAVGLTCALVGAISGASSQDFAGPLAAAALIIIAYAISGRSADVYLEKAGEISWSEDAKISGSSPRIDVCVTENGDFKLRHESEATWTRNCVLAACLVVAGVHPLGIPVAGLMWFGYVKSNKRGTVLWDIPSPQATSAPTVEDGCYRVMSRRLLGSTQLGVGIMLDSTFHTMWHITRGASIVSGEGRLDPYWADVKEDLVCYGGPWKIRNTWDGLSEVQLIAVAPKENPVNVQTMPGKFIVANGGEIGAVVLDYPPGTSGSPIVDQQGNVIGLYGNGVMINDQTYASAIAQAPAEVARTPTWFTDDMLRKGQLHVLDLHPGAGKTRKVLPEILKAAVEKRLRTLVLAPTRVVAKEMHEALTGLPVRYQTSAVAPNGSGGELIDVMCHATYTHRQLTPGRGVNYQLYIVDEAHFTDPASIAARGIIATRVRLGHAAAIFMTATPPGMSNPFPESNAHIEDEEREVPTKAWNAGYEWITDYGGKTVWFVPSIRMANTIAACLVRAGKTVIVLHSGSFNEEYQKTKSGNWDFVVTTDISEMGANFKASRVIDSRLSIKPMFSYAPSERVVIGSPRAVSPASAAQRRGRVGRDPRQLGDQYIYGGPVGEDSAEFVHWKEARILMDNVTVPGGLYPQFYEPEGGMCDAMDGAHRLTDAKREVFRDLMKKGELPVWLAYQVAQAGHAYTDRTWCYGGPADHQVYDDCGQTVDYRSLNGERRMLRPKWLDQRTYNDKTSLRLFTEFAEGRRRYSELMDVFGRMPQHMLDRTILAADTFKDVLTATPGSRVHRLALDNLPEATETMMVVGILSVSTLGVMLFLMSPKGMTRMTCGLVVIILATYFLWVSGMAGYQIAAMQLIAFILFVVLVPEPGSQRSVQDNTIAIILIVILSLAAIIAANEAGLLEKTKKDFAWKRESHVLVTPSPWNLDFSMDLRPATSWSLYVVMATMLGPVLEHAIVTNYASVSLTAITNQAGILLSMDKGTPFWNLDWSVVLLCVGSWSGINGTTLMVASTMTVLHFAMILPGIRAKAAREAQNRTAAGVSKNPLIDGLNTINIQPLPEMDPMYERKMGLWMLIAVAGAAVVFDKRMLHYTEFGVLGSAAVSPLIEGYASAVWNTSVAASVCNLMRGHYMAGIPMAYSLIRNLSMKGVPRRGLQATHTLGMVWKHKLNAMDKAAFNAYRKDGVTEVDREPAREAMKKGDLVSGWAVSRGSAKLRWMHERGYIPLQGVVIDLGCGRGGWSYYAAAQRRVTAVKGLTKGGPGHEEPINVQSYGWNLVTFRSGVDVFHTEVQPADTLLCDIGESSADPAVEKARTVQVLVNFERWIRESRCEHFCCKVLGPYSPEVMERLDRLTKTYGGAVIRNPLSRNSTHEMYWVSGAKGNPVNAITATSRVLIERMYRRLGKSYWEEDVNLGTGTRAVSCAAEKPDLAKIGRRIELLKKEYKASWFEDPEHPYKTWTYHGSYETKTTGSSSSMINGVVKEITHPWDTNPRVTTVCMTDTTPFGQQRVFKEKVDTKAREPSQGTREIMRIVSKWLTLYIGRSKRPRLCTADEFIAKVNADAALGTMFDSQGNWANAKEAVRDPRFWQLVAKERELHLRGQCATCVYNMMGKREKKLTEFGKSKGSRAIWFMWLGARFLEFESLGFLNEDHWLSRENSGGGVEGIGLQYLGYVLKEMALIPGGKMYADDTAGWDTRITNADLEDEMDILGLMDPHHKKLAKNLMELAYNNKVVRVMRPGKGGKTLMDIISRKDQRGSGQVVTYPLNTWTNLKVQLIRMAESEGVLDPKEIDGITVTTRNNLEKWLTSQGAERLKRIAASGDDVVVKPVDERFANALTYLNDMAKIRKDISEWKPSAGWFHWEEVPFCSHHFHQLVLKDGRTLVVPCRDQDELIGRARVSPGAGWTIRETAGLSKAYAQMWLLMHFHRRDLRMAGFAICSAVPSDWVPTGRTSWSLHAKGEWMTTEDMLAVWNRVWIEDNPHMSNKTLVGSWQDIPYQRKSLDIHCGSMIGQRSRSTWAANIRISIGHVRRLIGTTEKYLDYMQEQERFKIAEPTRLGNVI

SEQ ID NO: 7 - protein, 3400 aa, Bamaga virus
MSNPSVRRGVNVMAAQKKRVAQKIKSMRKGTQSISNGVRGFILFFISQIFWARKITPRVKGLWKKLDKFQAMKVLKGLRNIINGLMRSVAGKKKRRGGNTVPFLVMMMVATTWALTLRKIDNTIVLNVTQNDIGKTFPVRGGNCSININDAGYWCHNTVEYDCVTIAGTEEPDDIDCWCVGIEGVRVTYGKCSKSSPHGRRSRRAAVIPAHGGQGLSTHKETWLSTVAGERQIQRIERWIIRNPLYAAAMVTVAYFLGSDTKQKVLLAVLMLAIGPAYGSHCIGIERRDFVHGVQGSTWVNLVLDQGSCVTMVTENKPSVDVWLKEISLSQPTLVRRYSHTAKVHKTEIKAACPTMGEAKLDTEHNPSYECKRTYSDRGWGNGCGLFGKGSIIACAEFSSTGHMDVYEIDMTKIEYIVNSQIHGTVLVENNSQHAVESKFQPTTGGAEVTHAGYGTLGLDCHVQTMMDLNNFYLAVMGSDAWLVHKQWVEDLTLPWMAGETGHWKEKKYLVEFGEPHATKMEALVLGSQEGALRTALAGAMVVVYSQNDKKFTLKGGHVSCRARLTDLTLKGTSYPMCKGSLKFTKTPVDTGHGTAVMHVQVTKGAPCRIGVQMADNSNGGKSLGSMITSNPIVSTDGEETLVEVSPPYGESYIIVGSGDGKLVYHWHKTGSTIGSLFSETMKGAKRLAILGDDAWDFSSTGGVLASVGKMLHTVFGQAFHAIFGGLSWISKIILGCVMLWIGVNSRNGTLSVTLLTVGGILLFMTLGVNAEYGCSLDFQRKELKCGDGVFVFNDANDWLTKYRYHPEDPRTLASLVKASYKAGRCGLGSVDNMEHKMWVSLENELNAIFEENQENISVVVKESNGIYPKGNYPFTGTPEKLKYGWKTWGKKLVFAPVLSNNTFVIDGTPDDCPYSNRVWNSFEIDEFGAGLTHTRVFLKQRLERKEECDNALLGAAAKGDVAVHGDPNFWMASNKTGEVWQINELMSLNLKHCTWPLSHTLHGNGVLESDMFVPKSIGGPVSHHNFIKGYKSQVNGPWASVPLEMHRRECPDTVVQIDQNCSGRGKSTRSTTKEGKIIRDWCCRNCTLPPVSFDGPDGCWYAMEIRPQKMNEKHLVTSWVSAGDGMENGNIGLVALFVCFDMFLKNKNTRKISLVGALCLLGAMILGNVGFVDLIKFMIVVGEHFRSFNHGGDVSYLVLTAVFDIRPALLCGFVLRKKWSPSERVVMAIGMMLLQTVCGDWTQTSWWEWLDAVGLGLLILNAVALQRWKPAILVLLTMLTPLNMRVIQGAAGGVCGVMVAMSLWKTEGRSLRKSYLPVIGYVASAFGWGYSWIMAVYIMWATHVSRRSWPVGELAAAIGLLGAAMGMASTKDGAMVMPIAVLGLIMVIIGMTGKCDGMEIRKVGCVSWEDSAEISGSSSRYDVALSDGGEFQLLENSRPPWNHIIFLTLGMLASAVHPIVLGVVILAWGWFAGKSQRSGVLWDVPVAPKVEDHGPLEDGIYTIFQNGLFGSSQAGVGVAQGGVFHTMWHVTRGGILLHKGKRLTPGWASVKSDLISYGGKWRLDGSWDGVEEVQLIAVPPRKNPINVQTKPSIFKLKSGEEMGAIALDYPSGTSGSPIVNRAGVVVGLYGNGIVLNQGGYVSAISQAAVEEVSRDELPGIEGYLRKGQLTVLDFHPGAGKTRNFLPQILKACRTRKLRTLVLAPTRVVLSEMKEALNDHDVKYHTQAFSSASSGRELIDAMCHATLAYRLLESTRVINWEVVIMDEAHYMDPASIAVRGWAAHRARAHECATIFMSATPPGTANEFPESNGGIEDIRKDIPSEAWNKGHEWILEDRRPTVWFLPSIRSANNIAACLRKANRTVVVLNRQTFESVYPTIKTKKPDFILATDIAEMGANLHVERVIDCRTAFKPVLSEDQERVTLKGPMRISASAAAQRRGRVGRDPSRESDTYYYGEDTSEDNDHLVCWTEASMILDNMEIKGGMVAPLYSVEATKTKMTPGECRLRDDQRKTFRALIKKHELPVWVSWKVAKAGITPDDRKWCFDGEEDNTVLNDMGEKVMGRSPGGAKKALCPRWSDARLTSDNASLMNFLAFAEGRRSYMRIVDALIMVPPMLKEKVVDAADTLALLLRSEEGSRAYKLAQESAPEAITTLIMVTFLVLLSAGLVLMLMWPKGISKMSLGMLTMSVAGYLLLEGGLTQVQVAGILLVFFILMVVLIPDDGSQRSINDNKLAYMMTGIILLVGAVAANEMGWLEKTKQDLFGKREEMPGWNWDLGLDLRPGAAWTTYVALATVLGPVIDHWIQVEYGSASLTGIANSAGISAFLDKGVPFMKVNMAVVVLFVSAWNSYSMLAIMEGCLMAGIHFCLLIPGLKARAMKKAQKRIYHGLSKNPVVDGTPTVDIEEAEETPVLYEKKVALALLGVVAALNGIVVRTPFSMAESIVLGSALVGPFIEGNTSPLWNAPIAVAFAGLMRGHYSSMIGLAYNFWILQNPKRGGGETMTLGQVWKKRLNMLDKKEFAKYKISDIHEVDRRQARTILDAGITNVGVSVSRGTSKLKWLTDRGYFKPEGRVVDLGCGRGGWSYLAAAARETLEVKAYTLGVSGHERPIQIQSLGWNVIKFKDRVDVHRLPIAQCDTVMCDIGESSSSWEQERERTLRVIDLMENWVAKSRPKYCFKVLAPYSSEVIERLELFQRRFGGGIIRVPLSRNSTHEMYYTSEVTNNIVHMVNCVSRLLLRRMTNPSGIAILEPDVVFPTGTRNVKGDLGPLDMEKIKMRVSKLKKENLDTWWHDENHPYRTWHYLGSYVAKQSGSAATMVNGIVKLLSMPWDRIEDVTALAMTDTTPYGQQRVFKEKVDTRAPPPPPGTRKIMSITNTWLFDFLGRSKQPRLCTKAEFIAKVRSHAAIGNMLEEQEGWKNAAEAVNDPRFWELVSEERELHLQGKCSTCIYNMMGKREKKPAEFGRAKGSRAIWYMWLGARFLEFEALGFLNEDHWFSRDNSKGGVEGMGLQYLGYVVEDVWKKGNGIMYADDTAGWDTRITEADLEDEQYLLEKMSGTHKKLAWAITELTYKNKVVKVPRPGPGGKILMDVIARRDQRGSGQVVTYPLNTGTNLKTQLIRMAEGEGIITPEDTLQLSHKNEKNLREWLCTHGAERLGRMAVSGDDCIVAPIDERFGNALSHLNAMSKIRKDIDDWEPSKPWMKWEEVPFCSHHFHHLLLKDGRRIIVPCRNQDELIGRARVSPGNGWMIKETACHSKSYGQMWLLMYFHRRDLRLMANAISSCVPINWVPTGRTTWSLHAGGEWMTSEDMLEVWNRVWILDNPHMSDKSVILEWRDVPYLAKSDDIRCGSLIGTSQRACWAANIRSVVEKIRHLVGDEKYKDYLHSMDRYALEHSEIGCLI

SEQ ID NO: 8 - protein, 3433 aa, West Nile virus KUNV subtype
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGAVTLSNFQGKVMMTVNATDVTDIITIPTAAGKNLCIVRAMDVGHMCDDTITYECPVLSAGNDPEDIDCWCTKLAVYVRYGRCTKTRHSRRSRRSLTVQTHGESTLSNKKGAWMDSTKATRYLVKTESWILRNPGYALVAAVIGWMLGSNTMQRVVFAVLLLLVAPAYSFNCLGMSNRDFLEGVSGATWVDLVLEGDSCVTIMSKDKPTIDVKMMNMEAANLAEVRSYCYLATVSELSTKAACPTMGEAHNDKRADPSFVCKQGVVDRGWGNGCGLFGKGSIDTCAKFACSTKATGRTILKENIKYEVAIFVHGPTTVESHGNYFTQTGAAQAGRFSITPAAPSYTLKLGEYGEVTVDCEPRSGIDTSAYYVMTVGTKTFLVHREWFMDLNLPWSSAESNVWRNRETLMEFEEPHATKQSVIALGSQEGALHQALAGAIPVEFSSNTVKLTSGHLKCRVKMEKLQLKGTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSGSSIGKAFTATLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 9 - protein, 3423 aa, Zika virus
MKNPKKKSGGFRIVNMLKRGVARVSPFGGLKRLPAGLLLGHGPIRMVLAILAFLRFTAIKPSLGLINRWGSVGKKEAMEIIKKFKKDLAAMLRIINARKEKKRRGADTSVGIVGLLLTTAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADVGCSVDFSKKETRCGTGVFVYNDVEAWRDRYKYHPDSPRRLAAAVKQAWEDGICGISSVSRMENIMWRSVEGELNAILEENGVQLTVVVGSVKNPMWRGPQRLPVPVNELPHGWKAWGKSYFVRAAKTNNSFVVDGDTLKECPLEHRAWNSFLVEDHGFGVFHTSVWLKVREDYSLECDPAVIGTAVKGKEAVHSDLGYWIESEKNDTWRLKRAHLIEMKTCEWPKSHTLWADGIEESDLIIPKSLAGPLSHHNTREGYRTQMKGPWHSEELEIRFEECPGTKVHVEETCGTRGPSLRSTTASGRVIEEWCCRECTMPPLSFRAKDGCWYGMEIRPRKEPESNLVRSVVTAGSTDHMDHFSLGVLVILLMVQEGLKKRMTTKIIISTSMAVLVAMILGGFSMSDLAKLAILMGATFAEMNTGGDVAHLALIAAFKVRPALLVSFIFRANWTPRESMLLALASCLLQTAISALEGDLMVLINGFALAWLAIRAMVVPRTDNITLAILAALTPLARGTLLVAWRAGLATCGGFMLLSLKGKGSVKKNLPFVMALGLTAVRLVDPINVVGLLLLTRSGKRSWPPSEVLTAVGLICALAGGFAKADIEMAGPMAAVGLLIVSYVVSGKSVDMYIERAGDITWEKDAEVTGNSPRLDVALDESGDFSLVEDDGPPMREIILKVVLMTICGMNPIAIPFAAGAWYVYVKTGKRSGALWDVPAPKEVKKGETTDGVYRVMTRRLLGSTQVGVGVMQEGVFHTMWHVTKGSALRSGEGRLDPYWGDVKQDLVSYCGPWKLDAAWDGHSEVQLLAVPPGERARNIQTLPGIFKTKDGDIGAVALDYPAGTSGSPILDKCGRVIGLYGNGVVIKNGSYVSAITQGRREEETPVECFEPSMLKKKQLTVLDLHPGAGKTRRVLPEIVREAIKTRLRTVILAPTRVVAAEMEEALRGLPVRYMTTAVNVTHSGTEIVDLMCHATFTSRLLQPIRVPNYNLYIMDEAHFTDPSSIAARGYISTRVEMGEAAAIFMTATPPGTRDAFPDSNSPIMDTEVEVPERAWSSGFDWVTDHSGKTVWFVPSVRNGNEIAACLTKAGKRVIQLSRKTFETEFQKTKHQEWDFVVTTDISEMGANFKADRVIDSRRCLKPVILDGERVILAGPMPVTHASAAQRRGRIGRNPNKPGDEYLYGGGCAETDEDHAHWLEARMLLDNIYLQDGLIASLYRPEADKVAAIEGEFKLRTEQRKTFVELMKRGDLPVWLAYQVASAGITYTDRRWCFDGTTNNTIMEDSVPAEVWTRHGEKRVLKPRWMDARVCSDHAALKSFKEFAAGKRGAAFGVMEALGTLPGHMTERFQEAIDNLAVLMRAETGSRPYKAAAAQLPETLETIMLLGLLGTVSLGIFFVLMRNKGIGKMGFGMVTLGASAWLMWLSEIEPARIACVLIVVFLLLVVLIPEPEKQRSPQDNQMAIIIMVAVGLLGLITANELGWLERTKSDLSHLMGRREEGATIGFSMDIDLRPASAWAIYAALTTFITPAVQHAVTTSYNNYSLMAMATQAGVLFGMGKGMPFYAWDFGVPLLMIGCYSQLTPLTLIVAIILLVAHYMYLIPGLQAAAARAAQKRTAAGIMKNPVVDGIVVTDIDTMTIDPQVEKKMGQVLLIAVAVSSAILSRTAWGWGEAGALITAATSTLWEGSPNKYWNSSTATSLCNIFRGSYLAGASLIYIVTRNAGLVKRRGGGTGETLGEKWKARLNQMSALEFYSYKKSGITEVCREEARRALKDGVATGGHAVSRGSAKLRWLVERGYLQPYGKVIDLGCGRGGWSYYAATIRKVQEVKGYTKGGPGHEEPVLVQSYGWNIVRLKSGVDVFHMAAEPCDTLLCDIGESSSSPEVEEARTLRVLSMVGDWLEKRPGAFCIKVLCPYTSTMMETLERLQRRYGGGLVRVPLSRNSTHEMYWVSGAKSNTIKSVSTTSQLLLGRMDGPRRPVKYEEDVNLGSGTRAVVSCAEAPNMKIIGNRIERIRSEHAETWFFDENHPYRTWAYHGSYEAPTQGSASSLINGVVRLLSKPWDVVTGVTGIAMTDTTPYGQQRVFKEKVDTRVPDPQEGTRQVMSMVSSWLWKELGKHKRPRVCTKEEFINKVRSNAALGAIFEEEKEWKTAVEAVNDPRFWALVDKEREHHLRGECQSCVYNMMGKREKKQGEFGKAKGSRAIWYMWLGARFLEFEALGFLNEDHWMGRENSGGGVEGLGLQRLGYVLEEMSRIPGGRMYADDTAGWDTRISRFDLENEALITNQMEKGHRALALAIIKYTYQNKVVKVLRPAEKGKTVMDIISRQDQRGSGQVVTYALNTFTNLVVQLIRNMEAEEVLEMQDLWLLRRSEKVTNWLQSNGWDRLKRMAVSGDDCVVKPIDDRFAHALRFLNDMGKVRKDTQEWKPSTGWDNWEEVPFCSHHFNKLHLKDGRSIVVPCRHQDELIGRARVSPGAGWSIRETACLAKSYAQMWQLLYFHRRDLRLMANAICSSVPVDWVPTGRTTWSIHGKGEWMTTEDMLVVWNRVWIEENDHMEDKTPVTKWTDIPYLGKREDLWCGSLIGHRPRTTWAENIKNTVNMVRRIIGDEEKYMDYLSTQVRYLGEEGSTPGVL

SEQ ID NO: 10 - protein, 3391 aa, Dengue virus type 2
MNNQRKKARNTPFNMLKRERNRVSTVQQLTKRFSLGMLQGRGPLKLFMALVAFLRFLTIPPTAGILKRWGTIKKSKAINVLRGFRKEIGRMLNILNRRRRTAGMIIMLIPTVMAFHLTTRNGEPHMIVSRQEKGKSLLFKTKDGTNMCTLMAMDLGELCEDTITYKCPFLKQNEPEDIDCWCNSTSTWVTYGTCTTTGEHRREKRSVALVPHVGMGLETRTETWMSSEGAWKHAQRIETWILRHPGFTIMAAILAYTIGTTHFQRVLIFILLTAIAPSMTMRCIGISNRDFVEGVSGGSWVDIVLEHGSCVTTMAKNKPTLDFELIKTEAKQPATLRKYCIEAKLTNTTTDSRCPTQGEPTLNEEQDKRFVCKHSMVDRGWGNGCGLFGKGGIVTCAMFTCKKNMEGKIVQPENLEYTVVITPHSGEEHAVGNDTGKHGKEVKITPQSSITEAELTGYGTVTMECSPRTGLDFNEMVLLQMKDKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKIVKEIAETQHGTIVIRVQYEGDGSPCKIPFEIMDLEKRHVLGRLITVNPIVTEKDSPVNIEAEPPFGDSYIIIGVEPGQLKLDWFKKGSSIGQMFETTMRGAKRMAILGDTAWDFGSLGGVFTSIGKALHQVFGAIYGAAFSGVSWTMKILIGVIITWIGMNSRSTSLSVSLVLVGIVTLYLGVMVQADSGCVVSWKNKELKCGSGIFVTDNVHTWTEQYKFQPESPSKLASAIQKAHEEGICGIRSVTRLENLMWKQITSELNHILSENEVKLTIMTGDIKGIMQVGKRSLRPQPTELRYSWKTWGKAKTLSTELHNQTFLIDGPETAECPNTNRAWNSLEVEDYGFGVFTTNIWLRLREKQDVFCDSKLMSAAIKDNRAVHADMGYWIESALNDTWKIEKASFIEVKSCHWPKSHTLWSNGVLESEMVIPKNFAGPVSQHNNRPGYHTQTAGPWHLGKLEMDFDFCEGTTVVVTEDCGNRGPSLRTTTASGKLITEWCCRSCTLPPLRYRGEDGCWYGMEIRPLKEKEENLVSSLVTAGHGQIDNFSLGILGMALFLEEMLRTRVGTKHAILLVAVSFVTLITGNMSFRDLGRVMVMVGATMTDDIGMGVTYLALLAAFKVRPTFTAGLLLRKLTSKELMMTTIGIVLLSQSSIPETILELTDALALGMMVLKMVRNMEKYQLAVTIMAILCVPNAVILQNAWKVSCTILAVVSVSPLLLTSSQQKADWIPLALTIKGLNPTAIFLTTLSRTSKKRSWPLNEAIMAVGMVSILASSLLKNDIPMTGPLVAGGLLTVCYVLTGRSADLELERATDVKWDDQAEISGSSPILSITISEDGSMSIKNEEEEQTLTILIRTGLLVISGLFPVSIPITAAAWYLWEVKKQRAGVLWDVPSPPPVGKAELEDGAYRIKQKGILGYSQIGAGVYKEGTFHTMWHVTRGAVLMHKGKRIEPSWADVKKDLISYGGGWKLEGEWKEGEEVQVLALEPGKNPRAVQTKPGLFRTNTGTIGAVSLDFSPGTSGSPIVDKKGKVVGLYGNGVVTRSGAYVSAIAQTEKSIEDNPEIEDDIFRKRRLTIMDLHPGAGKTKRYLPAIVREAIKRGLRTLILAPTRVVAAEMEEALRGLPIRYQTPAIRAEHTGREIVDLMCHATFTMRLLSPIRVPNYNLIIMDEAHFTDPASIAARGYISTRVEMGEAAGIFMTATPPGSRDPFPQSNAPIMDEEREIPERSWNSGHEWVTDFKGKTVWFVPSIKTGNDIAACLRKNGKRVIQLSRKTFDSEYVKTRTNDWDFVVTTDISEMGANFKAERVIDPRRCMKPVILTDGEERVILAGPMPVTHSSAAQRRGRIGRNPRNENDQYIYMGEPLENDEDCAHWKEAKMLLDNINTPEGIIPSMFEPEREKVDAIDGEYRLRGEARKTFVDLMRRGDLPVWLAYKVAAEGINYADRRWCFDGTRNNQILEENVEVEIWTKEGERKKLKPRWLDARIYSDPLALKEFKEFAAGRKSLTLNLITEMGRLPTFMTQKARDALDNLAVLHTAEAGGKAYNHALSELPETLETLLLLTLLATVTGGIFLFLMSGRGIGKMTLGMCCIITASILLWYAQIQPHWIAASIILEFFLIVLLIPEPEKQRTPQDNQLTYVIIAILTVVAATMANEMGFLEKTKKDLGLGNIATQQPESNILDIDLRPASAWTLYAVATTFITPMLRHSIENSSVNVSLTAIANQATVLMGLGKGWPLSKMDIGVPLLAIGCYSQVNPITLTAALLLLVAHYAIIGPGLQAKATREAQKRAAAGIMKNPTVDGITVIDLDPIPYDPKFEKQLGQVMLLVLCVTQVLMMRTTWALCEALTLATGPVSTLWEGNPGRFWNTTIAVSMANIFRGSYLAGAGLLFSIMKNTTSTRRGTGNIGETLGEKWKSRLNALGKSEFQIYKKSGIQEVDRTLAKEGIKRGETDHHAVSRGSAKLRWFVERNLVTPEGKVVDLGCGRGGWSYYCGGLKNVREVKGLTKGGPGHEEPIPMSTYGWNLVRLQSGVDVFFVPPEKCDTLLCDIGESSPNPTVEAGRTLRVLNLVENWLNNNTQFCVKVLNPYMPSVIERMETLQRKYGGALVRNPLSRNSTHEMYWVSNASGNIVSSVNMISRMLINRFTMRHKKATYEPDVDLGSGTRNIGIESETPNLDIIGKRIEKIKQEHETSWHYDQDHPYKTWAYHGSYETKQTGSASSMVNGVVRLLTKPWDVVPMVTQMAMTDTTPFGQQRVFKEKVDTRTQEPKEGTKKLMKITAEWLWKELGKKKTPRMCTREEFTKKVRSNAALGAIFTDENKWKSAREAVEDSRFWELVDKERNLHLEGKCETCVYNMMGKREKKLGEFGKAKGSRAIWYMWLGARFLEFEALGFLNEDHWFSRENSLSGVEGEGLHKLGYILREVSKKEGGAMYADDTAGWDTRITIEDLKNEEMITNHMAGEHKKLAEAIFKLTYQNKVVRVQRPTPRGTVMDIISRRDQRGSGQVGTYGLNTFTNMEAQLIRQMEGEGIFKNIQHLTASEEIAVQDWLVRVGRERLSRMAISGDDCVVKPLDDRFARALTALNDMGKVRKDIQQWEPSRGWNDWTQVPFCSHHFHELIMKDGRTLVVPCRNQDELIGRARISQGAGWSLRETACLGKSYAQMWSLMYFHRRDLRLAANAICSAVPSHWVPTSRTTWSIHASHEWMTTEDMLTVWNKVWILENPWMEDKTPVESWEEIPYLGKREDQWCGSLIGLTSRATWAKNIQTAINQVRSLIGNEEYTDYMPSMKRFRREEEEAGVLW

SEQ ID NO: 11 - DNA, 11978 bp, Artificial Sequence
  Synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccggaaagatgaaaagtctaatgggagaattgggctttggatggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggagtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctgacttcggatgtggatttgacccagataggaaggtagcacagtgtggttctggctcattcgtgtggaagtcactggcccgttggccaatggctgatcacgctattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaaggtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacggctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtacacaatagacctagcaacacccacggacaagaggcttttcatgccgccacaatacggaggaccaatttcgtttgcgaaccacgtgcctggattccaggtgcaagaggactttccctggcagaaggcgaatatattaatgcgccagggaccggttccgggaacgaccgtagtccaggatccacactgtgatgaccggagcgcggcagtgccagttgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagattcaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgattacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgaccatcattatggacgagtgccactttctggacccgatgtccatcgcgtgccgcgggataatggatttccacaacagccgtggaacgaaggtcatcttcatgagtgcgacgcccccaggacgagcaggaaacgctgggtccaactttacaatagaagacagagccatcaagttccccaaggagttgaccgcatcgtggatcaaagacaagtcaataggcaagaccatcgtttttgtgccaacaattacgcaagctgtgaggctggctaaagagttgggaggggtggccttgacccgagatacgttcaatgatgccatggggaaggcccggagtccggaaacaatgtttataatctcaacagacatcagcgagatgggagccaatctcggagtgactactgttatcgacacaagaactgttataaaaccattagtgtctgacaaaggagtttcacttgaaagggttggtgtgaccccagcttcaatcatccagcgcaggggccgagtaggtcggcgggagcccggagtatacatttatccccttgacgtcgaaccagaggagcagccggaaaattgggtgtgttgggtggaggcgcaaatgatcttagatcaattgggctgccatccgatgagagaggagagcgaatttttccgcccacaaggcacgtaccggattgacgacgtagagcagcggaggtttctggggttgatcaaggaaaaactgccaatttggcttgcttggacttgggccagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactatacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcgtgggaacctcgaggagttgtcgttgacctgggatgtggacgaggaggttggtcccagcgcttggtgatggattaccgcgtcgctgaagtaagaggatacacacttggaggcaaagaacgtgagaatccccaaccgttccaaacgaaaggatataacttggcgaatttgaaggctggagttgacgtctataaaatggagccagtgaattgtaacaccataatttgcgacataggtgagagtgacccgcgtcctgaagttgaaaaaactcgaacgctgaaggttttgggaatgctggagaaatggctggaagtcaatccaaacgcctctttttgctgcaaagtgctatcaccttatcacttggacgtgcttcgaaagttagagtcgctgcaacacaagtataacgggcggctggttcgactgtcttacagtcggaactcaacagcagaaatgtattatgtgtcaggaaagagggcaaacgtggtggcaagcgtgtacttcatgcttgggtcgctggtaggtaggctgcggagacatgagccatcaatcatcgaccccccaccggttctagagatgggaaccagaagcgatccgcgagcaaaggccaaagcgcaagacttcgagatgatccgaagaagagtggaacgactacgaggagaaaatcggaaaacatggtttgtggacaacgaacatccatatgtgtcatttaactaccatggatccttcgtgactgatgaggtgacagcgggcggacaaacaacaaatcccttgattagacgcgttatgtggccatgggactttctgtctcgggtgacaacctttatgatgaccgatgtttcaacgtatgcccaacaaaaggtgctgcgtgaaaaagtggacactgtctctgaggagcccgacgagcgaatgaaagcaattaacagactcatcatgacacacttcgtgaaaatgttcaagcggcgcgggctgaaaccgagggtgttgacaccacaagactacatgaataatgtccaagccaacgcagccataggaggatggagcgaagtaatggattggcaaaacgtgcgcgatgctttggcagatcaacgattctgggacatggtagataacgagagggccttacacttgcgtggtgactgtgagctttgcatctataacacgatgggaaagaaagaaaagaagccatctgcctttggcactgcgaaaggttcacgcaccatctggtatatgtggctgggtagccgttatttagagtacgaggctttaggattcttgaacgaagatcattgggttgcacgagaaaactttccatgtggagtcggtggcgtcggcgttaactattttggatattacctgaaggaaatagccgggggaggccggtggcttatcgcagacgatgtcgcgggatgggacacgagaataacccaaggagatctagatgatgagctgttcatgttaaccgagcttgccccaaccacataccacaagaaattgataactgcgacaatgacgttggcttataaaaacatagtggccttattccctagaaatcatccgatgtaccgaagtggaactgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggagcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggcaggatatcatggtctatccaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaagagccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 12 - DNA, 11990 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccggaaagatgaaaagtctaatgggagaattgggctttggatggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgctgacttcggatgtggatttgacccagataggaaggtagcacagtgtggttctggctcattcgtgtggaagtcactggcccgttggccaatggctgatcacgctattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaaggtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacggctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtacacaatagacctagcaacacccacggacaagaggcttttcatgccgccacaatacggaggaccaatttcgtttgcgaaccacgtgcctggattccaggtgcaagaggactttccctggcagaaggcgaatatattaatgcgccagggaccggttccgggaacgaccgtagtccaggatccacactgtgatgaccggagcgcggcagtgccagttgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagattcaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgattacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgaccatcattatggacgagtgccactttctggacccgatgtccatcgcgtgccgcgggataatggatttccacaacagccgtggaacgaaggtcatcttcatgagtgcgacgcccccaggacgagcaggaaacgctgggtccaactttacaatagaagacagagccatcaagttccccaaggagttgaccgcatcgtggatcaaagacaagtcaataggcaagaccatcgtttttgtgccaacaattacgcaagctgtgaggctggctaaagagttgggaggggtggccttgacccgagatacgttcaatgatgccatggggaaggcccggagtccggaaacaatgtttataatctcaacagacatcagcgagatgggagccaatctcggagtgactactgttatcgacacaagaactgttataaaaccattagtgtctgacaaaggagtttcacttgaaagggttggtgtgaccccagcttcaatcatccagcgcaggggccgagtaggtcggcgggagcccggagtatacatttatccccttgacgtcgaaccagaggagcagccggaaaattgggtgtgttgggtggaggcgcaaatgatcttagatcaattgggctgccatccgatgagagaggagagcgaatttttccgcccacaaggcacgtaccggattgacgacgtagagcagcggaggtttctggggttgatcaaggaaaaactgccaatttggcttgcttggacttgggccagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactatacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcgtgggaacctcgaggagttgtcgttgacctgggatgtggacgaggaggttggtcccagcgcttggtgatggattaccgcgtcgctgaagtaagaggatacacacttggaggcaaagaacgtgagaatccccaaccgttccaaacgaaaggatataacttggcgaatttgaaggctggagttgacgtctataaaatggagccagtgaattgtaacaccataatttgcgacataggtgagagtgacccgcgtcctgaagttgaaaaaactcgaacgctgaaggttttgggaatgctggagaaatggctggaagtcaatccaaacgcctctttttgctgcaaagtgctatcaccttatcacttggacgtgcttcgaaagttagagtcgctgcaacacaagtataacgggcggctggttcgactgtcttacagtcggaactcaacagcagaaatgtattatgtgtcaggaaagagggcaaacgtggtggcaagcgtgtacttcatgcttgggtcgctggtaggtaggctgcggagacatgagccatcaatcatcgaccccccaccggttctagagatgggaaccagaagcgatccgcgagcaaaggccaaagcgcaagacttcgagatgatccgaagaagagtggaacgactacgaggagaaaatcggaaaacatggtttgtggacaacgaacatccatatgtgtcatttaactaccatggatccttcgtgactgatgaggtgacagcgggcggacaaacaacaaatcccttgattagacgcgttatgtggccatgggactttctgtctcgggtgacaacctttatgatgaccgatgtttcaacgtatgcccaacaaaaggtgctgcgtgaaaaagtggacactgtctctgaggagcccgacgagcgaatgaaagcaattaacagactcatcatgacacacttcgtgaaaatgttcaagcggcgcgggctgaaaccgagggtgttgacaccacaagactacatgaataatgtccaagccaacgcagccataggaggatggagcgaagtaatggattggcaaaacgtgcgcgatgctttggcagatcaacgattctgggacatggtagataacgagagggccttacacttgcgtggtgactgtgagctttgcatctataacacgatgggaaagaaagaaaagaagccatctgcctttggcactgcgaaaggttcacgcaccatctggtatatgtggctgggtagccgttatttagagtacgaggctttaggattcttgaacgaagatcattgggttgcacgagaaaactttccatgtggagtcggtggcgtcggcgttaactattttggatattacctgaaggaaatagccgggggaggccggtggcttatcgcagacgatgtcgcgggatgggacacgagaataacccaaggagatctagatgatgagctgttcatgttaaccgagcttgccccaaccacataccacaagaaattgataactgcgacaatgacgttggcttataaaaacatagtggccttattccctagaaatcatccgatgtaccgaagtggaactgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggagcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggcaggatatcatggtctatccaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaagagccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 13 - DNA, 23810 bp, Artificial Sequence
  synthetic
  misc_feature (11960)..(11960): n is a, c, g, or t
  misc_feature (11965)..(11965): n is a, c, g, or t
  misc_feature (11968)..(11968): n is a, c, g, or t
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccggaaagatgaaaagtctaatgggagaattgggctttggatggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggatttcatctgaccacacgcaacggagaaccacacatgatcgtcagtagacaagaaaaagggaaaagccttctgtttaagacaaaggacggcacgaacatgtgtaccctcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattatttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatgaaagacaaagcttggctggtgcacagacaatggttcctagacctaccgttgccatggctgcccggagcagacacacaaggatcaaattggatacagaaagagacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatctcaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggcgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcacatcactgtctgtgtcactggtattagtgggaatcgtgacactgtacttgggagttatggtgcaggccgacttcggatgtggatttgacccagataggaaggtagcacagtgtggttctggctcattcgtgtggaagtcactggcccgttggccaatggctgatcacgctattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaaggtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacggctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtacacaatagacctagcaacacccacggacaagaggcttttcatgccgccacaatacggaggaccaatttcgtttgcgaaccacgtgcctggattccaggtgcaagaggactttccctggcagaaggcgaatatattaatgcgccagggaccggttccgggaacgaccgtagtccaggatccacactgtgatgaccggagcgcggcagtgccagttgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagattcaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgattacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgaccatcattatggacgagtgccactttctggacccgatgtccatcgcgtgccgcgggataatggatttccacaacagccgtggaacgaaggtcatcttcatgagtgcgacgcccccaggacgagcaggaaacgctgggtccaactttacaatagaagacagagccatcaagttccccaaggagttgaccgcatcgtggatcaaagacaagtcaataggcaagaccatcgtttttgtgccaacaattacgcaagctgtgaggctggctaaagagttgggaggggtggccttgacccgagatacgttcaatgatgccatggggaaggcccggagtccggaaacaatgtttataatctcaacagacatcagcgagatgggagccaatctcggagtgactactgttatcgacacaagaactgttataaaaccattagtgtctgacaaaggagtttcacttgaaagggttggtgtgaccccagcttcaatcatccagcgcaggggccgagtaggtcggcgggagcccggagtatacatttatccccttgacgtcgaaccagaggagcagccggaaaattgggtgtgttgggtggaggcgcaaatgatcttagatcaattgggctgccatccgatgagagaggagagcgaatttttccgcccacaaggcacgtaccggattgacgacgtagagcagcggaggtttctggggttgatcaaggaaaaactgccaatttggcttgcttggacttgggccagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactatacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcgtgggaacctcgaggagttgtcgttgacctgggatgtggacgaggaggttggtcccagcgcttggtgatggattaccgcgtcgctgaagtaagaggatacacacttggaggcaaagaacgtgagaatccccaaccgttccaaacgaaaggatataacttggcgaatttgaaggctggagttgacgtctataaaatggagccagtgaattgtaacaccataatttgcgacataggtgagagtgacccgcgtcctgaagttgaaaaaactcgaacgctgaaggttttgggaatgctggagaaatggctggaagtcaatccaaacgcctctttttgctgcaaagtgctatcaccttatcacttggacgtgcttcgaaagttagagtcgctgcaacacaagtataacgggcggctggttcgactgtcttacagtcggaactcaacagcagaaatgtattatgtgtcaggaaagagggcaaacgtggtggcaagcgtgtacttcatgcttgggtcgctggtaggtaggctgcggagacatgagccatcaatcatcgaccccccaccggttctagagatgggaaccagaagcgatccgcgagcaaaggccaaagcgcaagacttcgagatgatccgaagaagagtggaacgactacgaggagaaaatcggaaaacatggtttgtggacaacgaacatccatatgtgtcatttaactaccatggatccttcgtgactgatgaggtgacagcgggcggacaaacaacaaatcccttgattagacgcgttatgtggccatgggactttctgtctcgggtgacaacctttatgatgaccgatgtttcaacgtatgcccaacaaaaggtgctgcgtgaaaaagtggacactgtctctgaggagcccgacgagcgaatgaaagcaattaacagactcatcatgacacacttcgtgaaaatgttcaagcggcgcgggctgaaaccgagggtgttgacaccacaagactacatgaataatgtccaagccaacgcagccataggaggatggagcgaagtaatggattggcaaaacgtgcgcgatgctttggcagatcaacgattctgggacatggtagataacgagagggccttacacttgcgtggtgactgtgagctttgcatctataacacgatgggaaagaaagaaaagaagccatctgcctttggcactgcgaaaggttcacgcaccatctggtatatgtggctgggtagccgttatttagagtacgaggctttaggattcttgaacgaagatcattgggttgcacgagaaaactttccatgtggagtcggtggcgtcggcgttaactattttggatattacctgaaggaaatagccgggggaggccggtggcttatcgcagacgatgtcgcgggatgggacacgagaataacccaaggagatctagatgatgagctgttcatgttaaccgagcttgccccaaccacataccacaagaaattgataactgcgacaatgacgttggcttataaaaacatagtggccttattccctagaaatcatccgatgtaccgaagtggaactgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggagcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggcaggatatcatggtctatccaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaagagccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtctsdnbgvwnvknrmchmrcsvctrgggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaaccgtaaaatccgtacgcttgttttggcacactagtttgtgacataaggcttttgtcgcgcgtattgggtttaactttttttcgagaaatcgagaggtaagaagaattgaaagacattatgtctaacccttccgtcaggaggggtgtcaatgtgatggcggctcagaaaaaacgagtcgcccaaaaaataaaatcaatgaggaagggaacccagagcatcagcaatggagttaggggtttcatcctctttttcatatcccaaatcttctgggcacgtaagatcacgcccagagtgaaaggattgtggaaaaaactagacaaatttcaggcaatgaaggttttgaaagggctaaggaacatcatcaatggattgatgagatcggtcgctgggaaaaagaaacgccgtggagggaataccgtgccattcttagtgatgatgatggtagcaacaacatgggccgtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctgagtacggttgctcattggacttccaaaggaaagaactgaagtgcggcgatggagttttcgtgttcaatgatgccaatgattggttgaccaagtacagatatcatcctgaagacccacgaacattggcttctctggtcaaggcttcatataaggccggacggtgtgggcttggatcagttgacaacatggaacataagatgtgggtgtccctggaaaatgagttgaatgccatctttgaggaaaaccaagaaaatatctcagtggtagtgaaggagagtaatggaatataccccaaaggaaattatccattcactggcactccagaaaagctgaaatatggatggaaaacatgggggaagaaattggtatttgccccggttttgagtaacaacacctttgtaatagatggaactcccgatgattgtccttacagcaacagagtttggaattcatttgagattgatgagttcggagcaggtttgactcataccagggtgtttttgaaacaaagactggaaagaaaagaagagtgtgacaatgcacttttaggagctgcagccaaaggggacgtggcagtccatggggatcccaacttctggatggcctcaaacaaaactggagaagtgtggcagatcaatgaattaatgtcactaaacctcaagcactgcacatggcccttgtctcatacgttgcatggcaatggagttctggaatcagacatgttcgttccgaaaagcattggaggaccggttagtcaccacaacttcattaaaggctacaaatctcaggtaaatggaccttgggcatcagtgcctctagaaatgcatcggagagagtgccctgacacagtggttcaaatagatcagaactgcagcgggagaggcaagtccacacggagcactacaaaggaagggaaaataatccgggattggtgttgtcgaaactgcacgctgccccctgttagctttgatggtcctgatggatgctggtatgctatggagattagaccgcagaagatgaatgaaaaacatttggtcacttcatgggtaagtgccggtgacgggatggaaaatggtaacattggattggtggctctctttgtgtgctttgacatgttcttgaagaacaagaacacccgaaagattagcttggttggagccttgtgtctattgggcgcaatgatccttgggaatgttggatttgttgatctaataaaattcatgattgtggttggtgaacatttccgctccttcaaccatggaggtgacgtctcctacttggtcctgaccgctgtctttgacatcaggccagccctgctctgcggctttgtgctgcgcaagaaatggagtcctagtgagagagtagtcatggccattggaatgatgctcctgcaaacggtgtgtggggattggactcagacatcttggtgggaatggctggatgctgttggattggggctcttgatcctcaatgcagtagctttacaaagatggaaaccggccattttggtcttgctgacaatgttgactccgctgaatatgcgagtaattcaaggtgctgcagggggagtgtgtggcgttatggtggccatgtctttgtggaaaacagaaggaagaagtctccgtaagagttacctgccagtcattggctatgttgcttcggcttttggatgggggtattcatggatcatggcagtgtacatcatgtgggcaacccatgtgtcaaggagatcttggcctgtaggagagctggcagcagcaattggacttttgggagctgcaatgggaatggcatccacaaaggatggagccatggtcatgccaatagctgtgctcggattaatcatggtgatcataggaatgacaggcaaatgcgatggaatggagattcgcaaagttgggtgtgtctcgtgggaagactccgctgagatcagtggttcaagctccaggtatgacgtggctcttagtgatggcggagaattccagctgttagagaattcgcggcccccctggaatcacatcattttcctcaccctgggaatgctggcgtcagcagtgcatccaatagtactgggtgtggtcatacttgcctgggggtggtttgcaggcaaaagccagcgcagtggagttttgtgggacgtgcctgttgctccaaaagttgaggaccatggaccccttgaggatggaatttacaccattttccagaatggattgtttgggagctcccaggctggagtaggagtggctcagggaggcgtgtttcacactatgtggcacgttactcgtggaggaatcctgctgcacaaaggtaaaagactcacccctggttgggctagtgtgaaaagtgacctcatttcgtatggaggtaaatggagacttgatggaagttgggatggagtcgaggaagttcagttgattgctgtccctcccaggaaaaatcctatcaatgttcaaactaagcccagcattttcaaattaaagagtggagaggagatgggagccatagctttggattaccctagtggaacttcaggatcacccattgtcaacagagctggagtcgttgtggggttgtatggaaatggaattgtgctcaatcagggtggttatgtgtcagctattagccaagcagctgtggaagaggtcagtagagatgagctacccggaattgaaggctacctgagaaaggggcaactcaccgttctggattttcacccaggggcaggaaagacacgtaacttcctgccccaaatcttgaaggcatgcaggacccgcaagttgcgaacactagtgctggccccaaccagagtggttctgagcgaaatgaaggaagctctgaatgatcacgatgtcaagtaccacacacaagctttctcatctgccagttcaggacgtgaactgattgacgctatgtgccatgcaacattggcatatagactattggaaagcactagggtgataaactgggaggttgtgataatggatgaggctcactacatggatccagccagcattgctgtgaggggttgggctgcccatagagctagagctcatgaatgtgcaacaatattcatgtcagcgactcccccagggactgcaaatgaatttcctgaatcaaatggaggcattgaggacatccgcaaggacatccccagtgaggcttggaacaaaggtcatgagtggatcctagaggatagaaggccaacggtgtggttcctgccctctataaggagcgcaaataacattgctgcatgtttgaggaaagccaacagaacggttgttgtgttaaacagacagacctttgaaagtgtgtaccccactatcaagacaaagaaaccggacttcatcctagccacagacattgctgagatgggggcaaatcttcatgtggaaagggtaattgactgccgaactgctttcaagccagtgctcagtgaggatcaggaacgggtaacactgaaagggccaatgagaatatcagcttctgcggcagctcagcgaagaggccgtgtggggagagatccatccagagagtctgacacatattactatggagaggacacctcagaggacaatgaccatttggtgtgctggactgaggcgtctatgattctggataacatggaaattaaagggggaatggtggctccgctgtacagcgtggaagccacaaagaccaaaatgacgccaggtgagtgtaggctaagagatgatcaaaggaaaacttttagagcattaataaagaaacatgagctgcctgtgtgggtctcatggaaggtggccaaagcaggaatcactccagatgataggaagtggtgttttgatggagaggaggacaacaccgtgcttaatgacatgggggagaaggtcatgggaagaagcccaggaggtgcaaagaaagctttgtgccctaggtggtcagacgcaaggctgactagtgacaatgcttccctcatgaacttcctggcatttgccgaggggaggagatcatacatgaggatcgttgacgctctcatcatggtgccccctatgctgaaagaaaaggtggtggatgcagcggacaccttagcactactactgcgttccgaggagggcagcagggcctacaaacttgctcaggagagcgctccagaagcgatcacaacactcatcatggtaaccttcctggttctgctatcagcaggactggttctgatgctcatgtggccaaaagggattagcaagatgtcattgggcatgctcaccatgagcgttgcgggataccttcttttggaaggagggctcacccaagtgcaggttgcaggaatattgctggtgtttttcatcttgatggtggttctaatccctgatgatggctcccagaggtcaatcaacgacaacaagctggcttacatgatgacaggaattatccttcttgttggagctgttgctgctaatgagatgggatggcttgaaaaaacgaaacaggatttgtttgggaaaagggaagaaatgccgggatggaactgggatttgggacttgacctaagacctggagcagcctggaccacttatgtggctctggcgactgtccttggcccagtgatagaccattggatacaagtggaatatggaagcgctagtttgactggcatagccaattcagcaggcatttccgcatttctggacaagggggttcctttcatgaaggtcaacatggcagtggtggttctgtttgtgagcgcatggaatagctattccatgctggccatcatggagggttgcctgatggcaggcattcatttttgcctgttaatccctgggctgaaggcaagagcaatgaagaaggcccaaaagaggatctatcatggtctatctaagaatccagtagttgatggcacacccactgtggatattgaagaagctgaagaaactccagtactgtatgagaagaaagtggctttggcactgctgggagttgtggctgcgctcaatggaattgtggtcagaacacctttctccatggctgaatcaattgtgctggggagtgccttggtgggtccttttattgagggtaacacgtctccactttggaacgcccctatcgcggttgcgttcgctggtctaatgcggggacattatagcagcatgataggattggcctacaatttttggatattgcaaaaccccaaaagaggaggtggtgagaccatgacccttggccaggtgtggaaaaagagactgaacatgcttgacaagaaggagtttgcaaaatacaagatttcagacattcatgaggtggaccgtaggcaagcacgtaccattctggacgcaggcatcaccaacgttggagtcagcgtgtcaagaggaacatccaagctgaagtggctgacagacagagggtactttaagccagaaggtagggttgtggatctcgggtgtggccgtggaggttggtcatacttggctgctgcagcaagagaaaccctggaagtgaaagcttacactctaggtgtgtcagggcatgagcgaccaattcaaatccaaagcctgggatggaatgttatcaagtttaaggacagagttgatgtgcacagacttccaatcgcccaatgtgacacagtgatgtgcgacattggagagtcttccagctcttgggaacaggagcgagagagaaccctgagggtaattgacctgatggagaactgggtggccaagagcagacccaaatactgcttcaaggttttggctccctactcctcagaagtgattgagcgtctggaactgtttcaaagaagatttggtggcgggataatcagggttccactctcacgcaactcaacccatgagatgtactacactagtgaggtcaccaataacattgtgcacatggtgaactgcgtctcaagattgctgctccggagaatgaccaaccccagtggaatagccatcttagagccagatgtggtttttccaacaggaacacgcaatgtcaagggggacttgggccccttggacatggagaagatcaagatgcgtgtatccaagttaaaaaaggagaacttggacacatggtggcatgatgaaaatcatccatacaggacctggcattaccttggaagctacgttgctaaacagagtggcagcgcagccactatggtcaatggaatagtcaagctactgagcatgccatgggataggattgaggatgttactgccttggccatgacagacacaacaccatatggacagcaacgtgtgtttaaggaaaaggttgacactagggctccaccccctcctccagggactaggaaaatcatgagcattaccaacacatggctctttgatttccttggccgaagcaaacaacctagactgtgcaccaaagcagagtttatagcaaaagtcagatcacacgctgccataggcaacatgttggaggagcaggaaggctggaaaaatgcagctgaggcagtgaatgatccaagattttgggaattggttagtgaagagagggagctacacttacaaggaaaatgctccacatgcatctacaacatgatgggaaaaagagagaagaaacccgctgaattcggacgtgccaagggaagcagagccatatggtacatgtggctcggagctaggttccttgaatttgaggccctgggtttcctcaatgaagatcattggttctccagagacaactccaagggtggtgttgaggggatgggcttgcagtacctaggctatgttgtggaagatgtgtggaagaaggggaatggaatcatgtatgcggatgacacagctggatgggacactaggataacagaggctgatttggaggatgaacaatacctgcttgaaaagatgagtggcactcacaagaaactggcttgggctattacagagttgacctacaagaacaaggtcgtcaaggtccctagacctggacctggaggaaagattctgatggatgtgattgccaggagggaccaaagaggttctgggcaggttgtcacctatcccctcaacactggaacaaatctcaagacacagttaataaggatggctgaaggcgagggcataatcaccccagaggacacactccaactcagtcacaagaatgagaaaaatttgagggaatggttgtgcacccatggtgctgaaagacttggtagaatggctgttagtggtgatgattgcattgttgcgccaattgatgagaggtttggcaacgccctaagtcatctcaatgccatgtcaaagattagaaaggacattgatgattgggagcccagcaagccttggatgaaatgggaggaggtgccattctgctcccaccatttccaccatttgctactgaaggatggcagaagaattattgttccatgccgaaaccaagatgagctgattggaagggcccgagtgtcaccaggaaatggatggatgatcaaagaaactgcatgccacagcaagtcctatggtcagatgtggctcctcatgtatttccataggagggatctgagattgatggctaacgcaatatcatcatgcgttcctatcaattgggtgccaactggaagaactacatggtcacttcacgctggaggagagtggatgacctccgaggacatgctggaagtgtggaacagagtttggattttggacaatcctcatatgagtgacaagtcagtaatcctagagtggagagatgttccatatctggcaaagagtgatgatatcaggtgtggatcattgatagggacatcacagagagcctgctgggcagctaacatccgttctgtggttgagaaaatcaggcatttggtgggagatgagaagtacaaagactacctgcactccatggacagatatgccctggaacactccgaaattggctgcttgatataaattaaagcactccattaaaccaaccaaacactccttcatcaaacaacactccatatttaaagtgtcaggccgggaaaccgccatggctaagctctgaggccatgcagtctgggagagcagcacattcttgcccacagttgtgcttaattacatttttgggagcctccctttgtcatgcgatgcatggtggcaaagcgacgaggactagtggttagaggagaccctccctgggctatgcatcaagtcggaccgtttctacgggaagctgtaaaccgtactgtccgtgacagcattccgaaaggttgggcgaagctgtaagcctgtaaaactttggagcctccgctctgcgacccgtgtaagcagagtcgatggggactagtggttagaggagaccctccacagcaaacaacacacacggatcacattgacaccagggatagaccggagattcttcttgcctctcgacagctttaggcaccgattgccaaactacgaagctgtcgagaaacgacaagaatct

SEQ ID NO: 14 - DNA, 11830 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaaccgtaaaatccgtacgcttgttttggcacactagtttgtgacataaggcttttgtcgcgcgtattgggtttaactttttttcgagaaatcgagaggtaagaagaattgaaagacattatgtctaacccttccgtcaggaggggtgtcaatgtgatggcggctcagaaaaaacgagtcgcccaaaaaataaaatcaatgaggaagggaacccagagcatcagcaatggagttaggggtttcatcctctttttcatatcccaaatcttctgggcacgtaagatcacgcccagagtgaaaggattgtggaaaaaactagacaaatttcaggcaatgaaggttttgaaagggctaaggaacatcatcaatggattgatgagatcggtcgctgggaaaaagaaacgccgtggagggaataccgtgccattcttagtgatgatgatggtagcaacaacatgggccgtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctgagtacggttgctcattggacttccaaaggaaagaactgaagtgcggcgatggagttttcgtgttcaatgatgccaatgattggttgaccaagtacagatatcatcctgaagacccacgaacattggcttctctggtcaaggcttcatataaggccggacggtgtgggcttggatcagttgacaacatggaacataagatgtgggtgtccctggaaaatgagttgaatgccatctttgaggaaaaccaagaaaatatctcagtggtagtgaaggagagtaatggaatataccccaaaggaaattatccattcactggcactccagaaaagctgaaatatggatggaaaacatgggggaagaaattggtatttgccccggttttgagtaacaacacctttgtaatagatggaactcccgatgattgtccttacagcaacagagtttggaattcatttgagattgatgagttcggagcaggtttgactcataccagggtgtttttgaaacaaagactggaaagaaaagaagagtgtgacaatgcacttttaggagctgcagccaaaggggacgtggcagtccatggggatcccaacttctggatggcctcaaacaaaactggagaagtgtggcagatcaatgaattaatgtcactaaacctcaagcactgcacatggcccttgtctcatacgttgcatggcaatggagttctggaatcagacatgttcgttccgaaaagcattggaggaccggttagtcaccacaacttcattaaaggctacaaatctcaggtaaatggaccttgggcatcagtgcctctagaaatgcatcggagagagtgccctgacacagtggttcaaatagatcagaactgcagcgggagaggcaagtccacacggagcactacaaaggaagggaaaataatccgggattggtgttgtcgaaactgcacgctgccccctgttagctttgatggtcctgatggatgctggtatgctatggagattagaccgcagaagatgaatgaaaaacatttggtcacttcatgggtaagtgccggtgacgggatggaaaatggtaacattggattggtggctctctttgtgtgctttgacatgttcttgaagaacaagaacacccgaaagattagcttggttggagccttgtgtctattgggcgcaatgatccttgggaatgttggatttgttgatctaataaaattcatgattgtggttggtgaacatttccgctccttcaaccatggaggtgacgtctcctacttggtcctgaccgctgtctttgacatcaggccagccctgctctgcggctttgtgctgcgcaagaaatggagtcctagtgagagagtagtcatggccattggaatgatgctcctgcaaacggtgtgtggggattggactcagacatcttggtgggaatggctggatgctgttggattggggctcttgatcctcaatgcagtagctttacaaagatggaaaccggccattttggtcttgctgacaatgttgactccgctgaatatgcgagtaattcaaggtgctgcagggggagtgtgtggcgttatggtggccatgtctttgtggaaaacagaaggaagaagtctccgtaagagttacctgccagtcattggctatgttgcttcggcttttggatgggggtattcatggatcatggcagtgtacatcatgtgggcaacccatgtgtcaaggagatcttggcctgtaggagagctggcagcagcaattggacttttgggagctgcaatgggaatggcatccacaaaggatggagccatggtcatgccaatagctgtgctcggattaatcatggtgatcataggaatgacaggcaaatgcgatggaatggagattcgcaaagttgggtgtgtctcgtgggaagactccgctgagatcagtggttcaagctccaggtatgacgtggctcttagtgatggcggagaattccagctgttagagaattcgcggcccccctggaatcacatcattttcctcaccctgggaatgctggcgtcagcagtgcatccaatagtactgggtgtggtcatacttgcctgggggtggtttgcaggcaaaagccagcgcagtggagttttgtgggacgtgcctgttgctccaaaagttgaggaccatggaccccttgaggatggaatttacaccattttccagaatggattgtttgggagctcccaggctggagtaggagtggctcagggaggcgtgtttcacactatgtggcacgttactcgtggaggaatcctgctgcacaaaggtaaaagactcacccctggttgggctagtgtgaaaagtgacctcatttcgtatggaggtaaatggagacttgatggaagttgggatggagtcgaggaagttcagttgattgctgtccctcccaggaaaaatcctatcaatgttcaaactaagcccagcattttcaaattaaagagtggagaggagatgggagccatagctttggattaccctagtggaacttcaggatcacccattgtcaacagagctggagtcgttgtggggttgtatggaaatggaattgtgctcaatcagggtggttatgtgtcagctattagccaagcagctgtggaagaggtcagtagagatgagctacccggaattgaaggctacctgagaaaggggcaactcaccgttctggattttcacccaggggcaggaaagacacgtaacttcctgccccaaatcttgaaggcatgcaggacccgcaagttgcgaacactagtgctggccccaaccagagtggttctgagcgaaatgaaggaagctctgaatgatcacgatgtcaagtaccacacacaagctttctcatctgccagttcaggacgtgaactgattgacgctatgtgccatgcaacattggcatatagactattggaaagcactagggtgataaactgggaggttgtgataatggatgaggctcactacatggatccagccagcattgctgtgaggggttgggctgcccatagagctagagctcatgaatgtgcaacaatattcatgtcagcgactcccccagggactgcaaatgaatttcctgaatcaaatggaggcattgaggacatccgcaaggacatccccagtgaggcttggaacaaaggtcatgagtggatcctagaggatagaaggccaacggtgtggttcctgccctctataaggagcgcaaataacattgctgcatgtttgaggaaagccaacagaacggttgttgtgttaaacagacagacctttgaaagtgtgtaccccactatcaagacaaagaaaccggacttcatcctagccacagacattgctgagatgggggcaaatcttcatgtggaaagggtaattgactgccgaactgctttcaagccagtgctcagtgaggatcaggaacgggtaacactgaaagggccaatgagaatatcagcttctgcggcagctcagcgaagaggccgtgtggggagagatccatccagagagtctgacacatattactatggagaggacacctcagaggacaatgaccatttggtgtgctggactgaggcgtctatgattctggataacatggaaattaaagggggaatggtggctccgctgtacagcgtggaagccacaaagaccaaaatgacgccaggtgagtgtaggctaagagatgatcaaaggaaaacttttagagcattaataaagaaacatgagctgcctgtgtgggtctcatggaaggtggccaaagcaggaatcactccagatgataggaagtggtgttttgatggagaggaggacaacaccgtgcttaatgacatgggggagaaggtcatgggaagaagcccaggaggtgcaaagaaagctttgtgccctaggtggtcagacgcaaggctgactagtgacaatgcttccctcatgaacttcctggcatttgccgaggggaggagatcatacatgaggatcgttgacgctctcatcatggtgccccctatgctgaaagaaaaggtggtggatgcagcggacaccttagcactactactgcgttccgaggagggcagcagggcctacaaacttgctcaggagagcgctccagaagcgatcacaacactcatcatggtaaccttcctggttctgctatcagcaggactggttctgatgctcatgtggccaaaagggattagcaagatgtcattgggcatgctcaccatgagcgttgcgggataccttcttttggaaggagggctcacccaagtgcaggttgcaggaatattgctggtgtttttcatcttgatggtggttctaatccctgatgatggctcccagaggtcaatcaacgacaacaagctggcttacatgatgacaggaattatccttcttgttggagctgttgctgctaatgagatgggatggcttgaaaaaacgaaacaggatttgtttgggaaaagggaagaaatgccgggatggaactgggatttgggacttgacctaagacctggagcagcctggaccacttatgtggctctggcgactgtccttggcccagtgatagaccattggatacaagtggaatatggaagcgctagtttgactggcatagccaattcagcaggcatttccgcatttctggacaagggggttcctttcatgaaggtcaacatggcagtggtggttctgtttgtgagcgcatggaatagctattccatgctggccatcatggagggttgcctgatggcaggcattcatttttgcctgttaatccctgggctgaaggcaagagcaatgaagaaggcccaaaagaggatctatcatggtctatctaagaatccagtagttgatggcacacccactgtggatattgaagaagctgaagaaactccagtactgtatgagaagaaagtggctttggcactgctgggagttgtggctgcgctcaatggaattgtggtcagaacacctttctccatggctgaatcaattgtgctggggagtgccttggtgggtccttttattgagggtaacacgtctccactttggaacgcccctatcgcggttgcgttcgctggtctaatgcggggacattatagcagcatgataggattggcctacaatttttggatattgcaaaaccccaaaagaggaggtggtgagaccatgacccttggccaggtgtggaaaaagagactgaacatgcttgacaagaaggagtttgcaaaatacaagatttcagacattcatgaggtggaccgtaggcaagcacgtaccattctggacgcaggcatcaccaacgttggagtcagcgtgtcaagaggaacatccaagctgaagtggctgacagacagagggtactttaagccagaaggtagggttgtggatctcgggtgtggccgtggaggttggtcatacttggctgctgcagcaagagaaaccctggaagtgaaagcttacactctaggtgtgtcagggcatgagcgaccaattcaaatccaaagcctgggatggaatgttatcaagtttaaggacagagttgatgtgcacagacttccaatcgcccaatgtgacacagtgatgtgcgacattggagagtcttccagctcttgggaacaggagcgagagagaaccctgagggtaattgacctgatggagaactgggtggccaagagcagacccaaatactgcttcaaggttttggctccctactcctcagaagtgattgagcgtctggaactgtttcaaagaagatttggtggcgggataatcagggttccactctcacgcaactcaacccatgagatgtactacactagtgaggtcaccaataacattgtgcacatggtgaactgcgtctcaagattgctgctccggagaatgaccaaccccagtggaatagccatcttagagccagatgtggtttttccaacaggaacacgcaatgtcaagggggacttgggccccttggacatggagaagatcaagatgcgtgtatccaagttaaaaaaggagaacttggacacatggtggcatgatgaaaatcatccatacaggacctggcattaccttggaagctacgttgctaaacagagtggcagcgcagccactatggtcaatggaatagtcaagctactgagcatgccatgggataggattgaggatgttactgccttggccatgacagacacaacaccatatggacagcaacgtgtgtttaaggaaaaggttgacactagggctccaccccctcctccagggactaggaaaatcatgagcattaccaacacatggctctttgatttccttggccgaagcaaacaacctagactgtgcaccaaagcagagtttatagcaaaagtcagatcacacgctgccataggcaacatgttggaggagcaggaaggctggaaaaatgcagctgaggcagtgaatgatccaagattttgggaattggttagtgaagagagggagctacacttacaaggaaaatgctccacatgcatctacaacatgatgggaaaaagagagaagaaacccgctgaattcggacgtgccaagggaagcagagccatatggtacatgtggctcggagctaggttccttgaatttgaggccctgggtttcctcaatgaagatcattggttctccagagacaactccaagggtggtgttgaggggatgggcttgcagtacctaggctatgttgtggaagatgtgtggaagaaggggaatggaatcatgtatgcggatgacacagctggatgggacactaggataacagaggctgatttggaggatgaacaatacctgcttgaaaagatgagtggcactcacaagaaactggcttgggctattacagagttgacctacaagaacaaggtcgtcaaggtccctagacctggacctggaggaaagattctgatggatgtgattgccaggagggaccaaagaggttctgggcaggttgtcacctatcccctcaacactggaacaaatctcaagacacagttaataaggatggctgaaggcgagggcataatcaccccagaggacacactccaactcagtcacaagaatgagaaaaatttgagggaatggttgtgcacccatggtgctgaaagacttggtagaatggctgttagtggtgatgattgcattgttgcgccaattgatgagaggtttggcaacgccctaagtcatctcaatgccatgtcaaagattagaaaggacattgatgattgggagcccagcaagccttggatgaaatgggaggaggtgccattctgctcccaccatttccaccatttgctactgaaggatggcagaagaattattgttccatgccgaaaccaagatgagctgattggaagggcccgagtgtcaccaggaaatggatggatgatcaaagaaactgcatgccacagcaagtcctatggtcagatgtggctcctcatgtatttccataggagggatctgagattgatggctaacgcaatatcatcatgcgttcctatcaattgggtgccaactggaagaactacatggtcacttcacgctggaggagagtggatgacctccgaggacatgctggaagtgtggaacagagtttggattttggacaatcctcatatgagtgacaagtcagtaatcctagagtggagagatgttccatatctggcaaagagtgatgatatcaggtgtggatcattgatagggacatcacagagagcctgctgggcagctaacatccgttctgtggttgagaaaatcaggcatttggtgggagatgagaagtacaaagactacctgcactccatggacagatatgccctggaacactccgaaattggctgcttgatataaattaaagcactccattaaaccaaccaaacactccttcatcaaacaacactccatatttaaagtgtcaggccgggaaaccgccatggctaagctctgaggccatgcagtctgggagagcagcacattcttgcccacagttgtgcttaattacatttttgggagcctccctttgtcatgcgatgcatggtggcaaagcgacgaggactagtggttagaggagaccctccctgggctatgcatcaagtcggaccgtttctacgggaagctgtaaaccgtactgtccgtgacagcattccgaaaggttgggcgaagctgtaagcctgtaaaactttggagcctccgctctgcgacccgtgtaagcagagtcgatggggactagtggttagaggagaccctccacagcaaacaacacacacggatcacattgacaccagggatagaccggagattcttcttgcctctcgacagctttaggcaccgattgccaaactacgaagctgtcgagaaacgacaagaatct

SEQ ID NO: 15 - DNA, 56 bp, Artificial Sequence
  synthetic
ctataaatacagcccgcaacgatctggtaaacacagttgaacagcatctgttcgaa

SEQ ID NO: 16 - DNA, 32 bp, Artificial Sequence
  synthetic
ctataaatacagcccgcaacgatctggtaaac

SEQ ID NO: 17 - protein, 3342 aa, Karumba virus
  misc_feature (593)..(593): Xaa can be any naturally occurring amino acid
  misc_feature (1786)..(1786): Xaa can be any naturally occurring amino acid
  misc_feature (2123)..(2123): Xaa can be any naturally occurring amino acid
MQVKKIKMRGGGGGKLGIKGIKTSSLRRALNMVSGDLNETLLKLVIAMIAIWNELLRNLRSLGRRVRKETRQRTGNNKHVVACFIIGLMAALACAKTMNGIMDKGEHVWKADWNVDFTNVKLPKDFCGSGIHVEKMCPQVDSLQDATIDCAGRHDQFLLSYTRCAAKNRVKRGEPGVVEPKVTNIWTITFNDELNSIIERVSGMLKNNRLMATAVICLVGAFKKWPTWLVVLLVLLPWTVVQASLADPFLILPKGDGLVKTRLYPGQISSISTHVGVLDISYMAVDIEEGRLVERLMSHCEVNGTYSQDCCALGCNLDLSKLNERNRACQTATYNRGWATGCPVFGLGSVATCVEVACSDSVEVSELTSQNIRIPLSLRLQHEELNVTMTTEAPVTSKFSHHGVVSISCQIGNPGFLAQQYVLSNGKHKAMFPISAVSGWPGIREIGGQYRNVDGSVKWGHVEANEIKVAAVYSDSIQWKTGIPIKTGIRDPLYLYCEVSLTDLTFKKIRACESPVEVSFMAGPTGLDGRLEIGLLEQVNKTCSITGSCEGCTLPHPTSVISTSDKKGHMHVECRTGTFTAIFGKQKFSFTCXTSYLRTIWATTAQAIGNYRKFGLDASGGPFLDLWNKIGPNFSRLEVVGILVVAALLIDKRLLLLLAIFGYVTYVRADVGCGIDLSRKTFSCGEGIFLWNDLSSQTWAYGVEVVETKLLEAYISQMLKERTKVCLLCEDILQCSAARRLAAVVAKSNPDVYYNDSLSYGAVFPMRKKSQITITADGRSAVVASFVIEGMITNSALGKLQWNVWNPRPTAEAMDDKVIRVLTTGSNITSVCSKAIGFEYVFERFTRKMYGSSVLVKSTSHISHTCPTYLAGAAIKNNRTIHTDGFLWMDSALQANGTYRLSSLSVLQSHECEWPVTHTINPTDPKDRSLFMPARFGAPASRANHMPGYLTQRTIPWDKAPIKLIYGVAPGTTIKEFPTCDDRGDALPILSQETREWCCKTCLSKGTPPFHLVVDGSLYYPEEVRPIPIPTKITESVAQPVTPPPVMKTMGAEATQDFQMGPGEGTFARLALLALALHLISQNTRHGWITRVACAAMLFSVTGLPYHLRYWWPVIGFSVLKNASGQSLLVSLWLALHTTGGHLVCLGSLLRQTRWCYRLQSLMMLVASLSLYRFRGITWLMNIIDLVAPLISISFLYKARTLLLGEVVLIGSGLALSWGNALLTLGVLFGTHMVIASLRKTANAFEPGLRANISLCNFPQQVVRDMWTVLKNWRRAPAPWRSSGRTHISQLAVYLLLLGLAYAFHLLNLEVLAGACVLIGFLWILMGEMLTSGELELRRVSALEIPQGLEKIVIDRDFQSEYGRFTDAGVKLDNFNDETNVKFSLLSLGFVAALITVNPVCGLTIGFLIWIFTSCPLAKDLAMAASCFRSDDGFAVLIPGVKEVAIGTRFFTLSDGVYSVCRRSWNGLSHVGAGVAKNNVFHTLYHVTRGEAISWASEKVGPTSGCALRDVVTYGGDWQFPLVTEDEAVVKIVNSDLTVSHCYTNVLSLNVQGEEYGVIGHDFMEGSSGSPVFSSQGEIMGLYGYGFYDRENRYNSLISYMKMEKEEEKVKTTEEQPTMRGTRTFINWHPGKGKTRKVILEEAVRHVNENKRLLILTPTRVVMTEVLQALTGNLPFGVRVGKHLSKSRSFQITVACHATLTSHVLQHGLKINFSTVIMDECHFLDPLSIAARGIMEHMHSKGAALMYLSATPPGKAPQAGSNYPIIDVPSMPRDVDRNFVTSQAGXKTIVFVPTIAQAQKLSDQIPGSVVLSRETFDVNMSKAANPETKVVISTEISEMGANLGVDTVIDTRLCVRPVVDGRFKVRLVKVPITHASAVQRRGRTGRRQPGRYIFDDKVEPSDECSHWVCWREAQMLLDQLDMTPMPEEAENFDPPGHYKLLSDQLKQFMELLTTEMPIWLAWNWANASSSRHTVIFGGSEVTDKTTPVITTPSGKQLYNPQFVDDRFEADDLTKFHATIQKYLRMRAHINWEGLAQGLWHVVTKSDSSMFKVAFQNTMERLHDLSRWDDDSLRTSDMTESVGTWIIVMLTAVSTFIISLLIFACCRCCKSSKTTRSQEVVYTXTVAERNVSGLWSSMTVPVLGWVAGIPGPILFVVAVCLGLVCAFMCNSATRSYVDHTLSWWVMVLSCIVAGLVAFELDLMPRTFAILSRVAATGARFDTGPSVEPFIVTGRHVTVELWVVIMAMYLTALIIAPILKSYIQGKSIAAVFANEPVASAYIGGMRLTTIYALQATICVGLFYFHANLPSCVVASVASFLFLMVFAFDVKYAFSPAVVRALEAKNNKRDTDRPSLERDEETKGRQLYYTLSVVMVALWVTIVRDQLTFVTAAGVGLHALMCLIVPDHPFHRNINQGIVTMLFGFLVEPVKWTFIVGFFLWGVMHYTSPNSYRSSNKGDAMNVGMKWKRLLNSLNQKQFDAYKSRSVDETPRGDYVSRGGLKMREIMEVHGWEPNGKVVDLGCGRGGWSQHLAMDRRVTEIKGYTLGGSNRENPEVFMTYGYNLCTLKPMVDVYKLEPFVTNTVICDIGESDPSAVVEKTRTLKVLTLLENWLTVSKEANFVCKVLSPYHTEVLKKLETLQHVYGGRLVRLRLSRNSTAEMYYISGPRSNMVKAVYATLRALTGRLSLYDTPFESLPPTLPTGTRADPKAKAKAADFSLLARRIQKLQQENQHTWFHDKENPYTSFSYHGSFVTDAVSGGGQTVNPIIRRLMWPWEQVAKVTGFMMTDVSTYAQQKVLREKVDTYVEEPDHRMKQINRQLALFIADLYKKQGLRPRILSKQDFVANVRSDAAVGGWASDMPWADVEGAITDPVFWDMVDRERQLHLGGDCELCVYNTMGKKEKKPAVLGKAKGSRTIWYMWLGSRFLEYEALGFLNQDHWVSRDHLPCGVGGVGVNYFGNYLKEIAEKGKWLIADDVAGWDTRITESDIEDERSLLLSLVKDPYHKALMDSIFTMAYRNIVALFPRNHKKFGSGTVMDVVSRTDQRGSGQVVTYALNTITNAKVQLGRSLEAAGLLEADDRTIQVWLRNHGEETLRGMTVAGDDVVVATNSDSFHTSLHYLNRNSKIRKDIGPLEPSRRCDNWEEVEFCSHHFHPITLQDGRVLIVPCREQNEIIGRSRLQKGGIVSESEGACLAKAHGQMWALYFFHRRDMRLAYAAITACVPSHWFPKGRTSWSVHQKHEWMTTVDMLEVWNNVWIHDNPWMTNKEPVSSWSMVPYLPKKQDIACGSRIGTTDRTLWAKEMPELVSKLRRVLDKHEGPQQYTDGLAILGRYQQSPGNTADIYV

SEQ ID NO: 18 - protein, 3384 aa, Parramatta River virus
MSGLGGLLPLRGKKKKAPVIQSQGRVLPKSDWKGAPKQDLNKKKAKKDETKGQNWPRRINPRTGQWSAIEGSGARLWRSIFSTDLIGGLLLLIAILSNLYEKVRRDITELKRRVTRLEKSRASLILTPMVLLCLAILAAGVTIQVVVTTDARIELWSDRKNFTAHAHLVKVPTDVCNDGVFVTKHCPKVEKLSDLGEIDCGSSWSEFTLTYTRCVTLERASRAEEKGKTMLGQFKEDLSTLETEAFLLFKKHAFSTILVLLVLAIVMKWPVWVVVILGILAWNVVKGEFVEPFLVLKHDHSTMLMTRLYPGEIAHVATPAGLVDIRVSHAQIFGGQRFRELLSDCSVNASYSTDICPGGSQLDLESIKGPGRVCMTAPYNRGWGTGCFKWGIGAVATCVELNCTRETKVDLLTNSAIVANVTVNFHSTNDTKLLVPDTPITLKFGKLGTMTMTCRLGNDRIANDFYHVTDNIASGLFQKALIDAWEGPSKMANHISGHEKVVKWGHILPNEIKVSKIIEMELDWEKAITTHDGFSNTYFWCQVAVNKLVVGSFASCKSGAKASFIQSSWGFDGVVEVTLDEATKTICSLPLTCTGCSLLATKVVFLEGSQRAVGHVGCGNGTSMLTVGTTKVGIQCVVTPVSQIWNFVTHASGRYAKLGFGGVGGAFHDLLVKVGLTFTWDSWKIITVLSGLVVAFAIFDRKLVILIIILCGIAYTRADIGCGIDFDRKTYTCGSGLFVWKGLGKYPTADHSVEFASYDFLSAYLQEQFKSEKKVCIICEDIVQCEAARKAAAAVYKNLGHPFVYVNTSDSYGKVFAEIPKRVHTVSVGVDVVEMAMMTRENKPVGPFGDLPRSMVSWKSIPETEEHPVLRVLTSSSDYQKVCGKAIGFQYDFVGYRRTMYGSNVQLKISKKVSIECPTYLAGVAVKNDRTVFTDGMFWMSSKRENGTYAITELEMEQSHKCIWPDQYTPDATLTPRDNEMFVPPEWGGPMSKANHIPGYKMQTGFPWNKAPIRFVEGSVPGTIVTQISHCDGRGIAAEVNPATQPNWCCKSCTRIFHFEVDGKLYYPMEIRPDPKGGEQQKVPVVETPIGDEETETVGGWLGRMYNIPGAEGSYADFRLPKLPNSRPSAMVGSLVNLLCLMFSIQIVTKTMRARTLMRFYLCCLVFMFFGMPTLFGLSGFLAWMMILPISHNSVTMCNLTVHLWAVLLNQSSAMFLWGLTLRSQIQRSTAGQMLLFTMQMLHHAIYAHSWVFGWVIEVCLSVGLMMNLLTVIDTVHPKLIAYLLFFGWKTGMCVVCAWLLIYSIRRWNSIVAAAPAAGGWRSGYRTMMSSSLIVIFISVGIAGVIASDYGGYPAAAAVTAALLIMGIKMFDFLTTRLSLEFVSAGMFPEGVEKAFEPDSVSDLFRASFTVDGIKLQDHVEPIPILFAILYIFIGAVACKVNPALGIVYAIAMFATPLPELMRLYMMTIYSSTFRTDTLLGMAIPETEPELSQDFGPIPDGIYRVNNHGFSVKSHRGVGIVKNGVFHTLMHVTLNEPLAWQNRLVGPSMGHSLKDYVTYGGNWQLPDFDIVNEVGIMVCGRDRSIQYKRHEVGTIMIDDKRVMYFTHDYGHGSSGSPIFVNGEPVALYGFGFHLYNRYRSIVLPIPREEVLDGASNEGIPAEHGTMRNKFFVDWHPGKGKTRKVIVKEVLNALNLARRIVVLAPTRVVLAEITKAIGENTSKTPSKNLAFTGHNIVTVACHATFTDYVLRHGLSKFKAHEVIMDECHFLDPRSIAARGILEHLATKRGVKVTFMSATIPGREPSLGSNFEISEQALQFPRDVNQRWIETVARGKTVAFVPSHRVGDKLARGCPQAISLHRNNFDTNYSTAMDESIKFIYTTDISEMGANFSADTVIDFRVAIKPKISSEFAVTLEPTPITRSSMIQRRGRVGRQRPGTYIYPVDKGVEDASDQLACWTEAQMLLDQLDLTMMAEEVRQSNIPGAYKLVGRSLDIFRKLLEKDDIPIWLSWKWADSVQQQYSILFEGERQENVARVVNTRDYASLEYKPKFVDARFERLGWDQRKLSIQFYMNTRSFITFATLSHVISQVIEAGVVNSAWKRIGDVSIIFTEGGDPHAKDETIMAWTILVGGVLGALGFLIVAWGMKAVLRVIFGSRDKHLSVPTLVADFQPYIVCIVPIALHLAGVPIPMTIVFFAMLFLTYPLMYKSAGQRSYVDIDLVKWILLGGCIVTGVICWEMRLLPNISSDISAILNRQRQREDTPTFDASPPWEWLDLAQPVPHNVELTSVVITTFTTCLFLHQIVGWSYESEWLKSYFDHKGVGQIMGGFRLDTISWGSALSGLLGTATYASWGAILTGLGGAVVYFFLMVSMLKWNFSGGATTGLENNVMRNDRETGLGNRPANDNRRSLLYGVVAAECLVWLFCFRTATDAIVVACLVSYCLWIINNPASPHHKNTDLGSACSFIGLLYCTCPTQKCIQVLMRFALARLNMNTRSLEKSATGGLGHRWKKLLNAMTLLEFNAYRSCGVDETEKGDYVSRGGLKLREITMKYGWKPEGICVDLGCGRGGWSQHLAMDPRVTRVESFTLGGTARENPQPIKTLGHNLIRFKSGVNVYNMTPTHANTIVCDIGESDPKPEVETSRTLRVLKTLELWLARNPNAEFVCKVLCPYPVEVLKCLETLQHKYGGRIIRSTYSRNSSAEMYYISGGRNNMVKVIFTTLHSLISRIRTRPEKIVKESVSLPVGTRSDPGHKIKSMDPKMIATRVEKIKKEHADTWFVDNNHPYQSFRYVGSYVTDDVTPGGQTVNPLMRKMMWPWETVGGVVNFMMTDVSTYAQQKVLREKVDTLSPEPPNDIQRVNRWITEFLCASFMRRGLKPRILTMEQYINNVKSSAAIGSWSSDVPWSSVREALADKRFHQMVEEERKLHLAGDCRMCVYNTMGKKEKKPSAMGVAKGSRTIWYMWLGSRFLEYEALGFLNEDHWVSRDNLACGVGGVGVNYFGYYLQEIARKGKFFIADDIAGWDTRINESDLADEEFLIMSLICDPYHRSLAKAVFRFAYQNIVALFPRNHPGFGSGTVMDVVARTDQRGSGQVVTYALNTITNAKIQLGRMLEAEGLLDAHEHVIKKWLNDNGEEALSGMVVAGDDVVVATNNGNFSRSLRYLHLNGKIRKDIDPSLPSKVETNWEVVEFCSHHYHVMTLKDGRRIIVPCREQNEIIGRGRIQKGGLVTLAESACLAKAYGQMWALYFFHRRDLRMAFLAITSSVPIDWFPEGRTSWSIHQNKEWMTTEDMLRVWNTVWIQDNPWMEDKMEIENWRDIPYLPKSMDLKCGSLIGTKERAAWSKDLPSTVTAVRKIIDQDTKTENVYQDFLGGMGRFQTYTDPMAT

SEQ ID NO: 19 - protein, 3341 aa, Cell fusing agent virus
MKRKDLEARGKAPGRDFSTPFWGREGRRKDKEKGGESPSNRQVTLNTPIQSGRRAGKRQRVGLLGRLGVGWGSFLQEDIVQALIHMALVLHALFSSIDRRIRSLSRRVTALESRRTTGDPMTLAFILGFLTVLCGCVVIDMQVSTAKGTEIFEGKTNRTDYLHLVKLPADGCWSGILVTKKCPKVTDLAKDLESTDCGSTWTEFTLRYRRCAVKKREKRSREPPKADLLAEMEIIAFKTIRENKTIFIVALLCVAIAKRWPTWVVILLAIGTWTTVKGEFVEPLYTLKAEQMTMLQTIVRPEEGYVVATPNGLLEFKTGPAEIYGGQWLRELLADCHVNASYSTDVCPGGSQLNMADIMAKERVCSTQPYNRGWGTGCFKWGIGFVGTCVELHCDRGFNVSSIARSAIVMNVTASFHSVSDTQQMVGDIPLTFRFAKLGNAAMTCRLESEQLLLDYYHVTGSSHEGLFLRSQIDSWPGVHSTASGRHGMEKVVVWGDARSNEILVKNVIEPSLSWEDAIATHDGFRDISFVCQIMLDKLVSGAFRDCPGPKTSTFSQDGFGYSGVVITTLTASSNETCSLSLTCHGCLLQSTKMIFLAGKTTSRAFVKCGNHTSTLLVGSTSVSIECALNPISQGWRLARHVVDRYRRFGVSGVAGVWQDLVGKFSVGAFFSNTTLLVIFVLAALIDKRIAFLLVLGGYFYYVRADLGCGIDTTRKTISCGSGAFVWKHLGVGISNDHAVELEDYSFTDLYIKDMFSWTTKPCLICEDALQCVALRRAAFSAVGSMGPEQVYVNDTLARTFKFSETPKRTISVTINLIQYKFSSYVAHGRAEGDLGHLPTMFGSYPEKEADKVIRIVASRPDIRRLCGKAVSFQFKFTGFRRGLYGSNVQVEVSKNSSTECPTYLAGVVVKNGRTVITDGMFWLESTVLDGVAQITSLEMRQSHRCVWPREYTPDTLSDPSDQALFIPPAWGGPISRVNHIIGYKTQTDFPWNVSDITLIEGPAPGTKVKVDSRCHGRMHAQVIGPNDTESWCCQSCTRIVHFRVGDLLYYPMEIQLGTMSEAPEPNSKIFEEPIGEEPEPTVDDILKRYGKANAQSDFRRVSPRAGVGFDRSLLNLLCLAISLQLIGAKTRTSTLTRLFLTILAMALFGLPNLFSSVGLSAWVLLVASSSSQPQDLLMNLWIILQTGSSAVLLLGYMIRKKLSIVLGVHHLVTLMCIQFLFSAVDRYQKYLYGLLELMASVVLLSAYKSVLQALPPEVLCFSLIMGWKTALSLATVVSLIFSLNAMYKYACQYHNPRNGYRDSGANLWFWTVSLASAGGIWAAEKAHQPTVAAVLAFTMIVLFLYMEQTNVSMELEFISAGETPEGVSTENDDGMNIPDLKGRYGEDGIVVGAASSSGHLPELVFVFLLGFAVTSTSYFLGALYLLIATSTNLPVTIIRMLRMKLTANNRSDDLLGLGGPIETDLQTSFQDIPNGVYRIVVRSLFGDRQRGAGFSKNGVFHTLMHVTRGEPVKWRGRVVVPHSGSALRDVVSYGGPWQLDTPTTTEDLVLMACKPDKTVEYHRYRPGVMSIDGEPVMFISDDFGKGSSGSPFFINGEPVGFYGFGFYVNGIYRSTVAGGKPTDVTENLDCDSTRRFVTWHPGKGKTRKVIVEETKKNYDSNQRTVILTPTRVVMAEVVEALKNSGMRSDKNLSYCTRNLITVACHATFTKFVLSHGAKKVRVAMIIMDECHFMDPMSIAARGIMEHLHSQGTKLIYLSATPPGHAPDTGSNYAISDQSISFPTWLSPAWIGNVQKSVGAKKTILFVPSHNQANTLASAIPGSVPLHRANFSTNYAQAGDAATALVISTDISEMGANLGVDLVIDTRRALRPLVDSATRVKLVETNITTSSMIQRRGRTGRREPGTYVYPIDSQTEENPVSWACWPEAQMILDQLGMTFMLEEAAYSQPPGRFTLVGEDRMRFSKLMDRDDIPIWLAWHWAEAGDRRHSALFQGEGTGKIIENRFGKQEYRPQYVDDRFESVEWETRKVSIDFYMNCRGGPSLYEFFTLIDWTDIWRRTTSALWDLSDVMNGELRDRSTTERSLTVLMAFVLGVSIVLSCFIAVWALCFLFSLFRPRKVTYEQMPSSDPLSGGVLVSTPSLLYYMGVPLGFCVVISLAMFLVYPVLYKSIGNRSYMDSDLVKWVILGSCLICGVLAWEMRMFPNIRGDLMELVKAVKEPEEVVNSGPFFPSWEIARGKGATMLDSLQVFFFITVLSTKFLYWFQENWTARMYAMKHPEMVSSIGGFRFDEIPFRAVLPSGFAIVAIASLSSVVVGLLAAGVFMAIMYCQNKWNATPKILTALDARDQRHDRPTEITSRVPLENTRSIMYAFCLIFSLFWAFCTRSPGDFLRGSLVVGASMWQILHPRSKIHDVMDFGSMVSAIGLLEMNYLFYRFMHIAARALGAVAPFNQFRALEKSTTIGLGMKWKMTLNALDGDAFTKYKSRGVNETERGDYVSRGGLKLNEIISKYEWRPSGRVVDLGCGRGGWSQRAVMEETVSSALGFTIGGAEKENPQRFVTKGYNLATLKTGVDVHRLTPFRCDTIMCDIGESDPSPIKEKTRTLKVLQLLENWLLVNPGAHFVCKILSPYSLEVLRKIESLQHLYNGRLVRLSHSRNSSAEMYYISGARSNVVRTTYMTLAALMARFSRHLDSVVLPSPVLPKGTRADPAASVASMNTNDMTDRVERLMNENRGTWFEDQQHPYKSFKYFGSFVTDDVKVGGQAVNPLVRKIMWPWETLTSVVGFSMTDVSTYSQQKVLREKVDTVIPPHPQHIRRVNRTITKHFIRFFKNRNLRPRILSKEEFIANVRNDAAVGSWSRDVPWRDVQEAIQDQCFWDLIGKERALHLQGKCEMCIYNTMGKKEKKPSLAGEAKGSRTIWYMWLGSRFLEFEALGFLNADHWVSREHFPGGVGGVGVNYFGYYLKDIASRGKYLFADDIAGWDTKISAEDLEDEEALLTALTEDPHHRALMAATMRLAYQNIVAMFPRTHSKYGSGTVMDVVGRRDQRGSGQVVTYALNTITNGKVQVARVLESEGLLHADESVLDAWLEKHLEEALGNMVIAGDDVVVSTDNRDFSSALEYLELTGKTRKNVPQGAPSRMESDWEKVEFCSHHYHEMCLKDGRILIAPCRHENEVLGRSRLQKGGVVSISESACMAKAYAQMWALYFFHRRDLRLGFIAISSAVPTNWFPLGRTSWSVHQHHEWMTTDDMLRVWNDVWVHNNPWILNKESIESWDDIPYLHKKQDITCGSLIGVKERATWAREIENSVISVRRIIDAETGVLNTYKDELSVMSRYRRGNDVI

SEQ ID NO: 20 - protein, 3337 aa, Artificial Sequence
  Synthetic
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGAVVVIDMRVTYDGQVQIYRDGENMTDRVALFKLPTDGCSVGLPVSKMCHKVDKNMKEGLADTDCGSTWAEFRLRYQRCQVKTRAKRVAPDGPKQDFLAEVEIVAFKAIRENKSVLLVVVLCVAIAKRWPLWVLILLSIGTWTTVRGEYMEPLYVLKADQMTMIQTTLRPEEGYVTATANGLFEMKTGRAFIYGSQVVKTLVTDCEVNATYSTDICPGGSQLSMQDIQAEGRACASEPYNRGWGTGCFKWGVGFVATCAEVDCTTSVKVSSVARSTIKMNVTATYHSVKSVQSVISDVPVTFQFGQLGIASMTCRLESDRIAQSYYHVEGNKKEGLFMKEQIDGWNGATLAAGKIANTEKIVIWGDVKPNEILVKAVSEPQLEWTNAIATHDGFRDVGFVCQIMLDKLVTGVFKDCKTPKTSTFTQSGFGFDGIITTTLAVAQTEACSISISCKGCTLLATKAVFSAGDIESKTWVRCGNESGTAIVGGQEVAVACATNPITQGWRLVKHATQRYRKFGMPGVGGVFHDLVGTLNPWSFFSTTTLVFMAVVLFIVDKRILILGIACYMFYFVRADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 21 - DNA, 11692 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcagttgtggtgattgacatgcgtgtgacgtatgacggacaagtgcagatttatcgcgacggagagaatatgacagatcgagttgcgctctttaagctgccaactgacggttgttcagttgggttgccagtttcaaagatgtgccacaaagtggataaaaacatgaaagaaggattagcggacacggattgcggatcaacatgggcagagtttaggttgagataccaacgatgccaagtgaagacacgagcgaagcgagttgcgccagatggcccaaagcaagactttttggcagaagtggaaatagtggcttttaaagccatccgggaaaacaaaagtgtgttgcttgtggtcgtgttgtgcgtggccatcgcgaaaagatggccattgtgggtgttgatactactgtcgattggaacatggacaacggttcgaggagaatacatggaaccgttgtatgtattgaaagcagaccagatgacaatgattcagacaacgttgaggccagaagagggatacgtgacagcgacggcaaatgggttatttgagatgaaaacaggaagagcgttcatctatggaagccaagtggtgaaaacactggtaactgactgtgaagttaacgcgacatattcaactgatatatgcccaggcggatcgcagctgtcaatgcaggacattcaagcggaaggaagagcatgtgcctcggagccgtataatcgaggctggggcactgggtgttttaagtggggagttggattcgtagcaacatgcgcggaggttgattgcaccactagtgtgaaagttagctcagtggctcgctcgacaattaagatgaatgtgacggcaacataccactcagtgaaaagtgtgcagagtgtgataagtgatgtacctgtgacattccaatttgggcagctgggcattgcctctatgacatgtcgtttggagtccgaccgaattgcccaatcatactatcacgtggaaggaaacaagaaggagggactattcatgaaggaacagattgatggatggaacggagccacgttggctgctggaaagatagccaacacagagaaaattgttatttggggagatgtgaaaccaaatgaaattttggttaaggcggtttcagaaccccaactggaatggactaatgctatagctacacatgatggcttccgagatgtgggatttgtttgccagataatgcttgacaagcttgttaccggagtgtttaaagattgtaagacccctaaaacgtccacattcacacaaagcggatttggctttgacggaattataactaccacgttagctgtcgcccaaactgaagcctgctcgatcagcatctcctgtaaaggatgcacgcttttggcaacaaaagcagtgttttccgctggggatattgagtcgaagacatgggtgcgatgcggaaacgagagtggaacagcgatcgttggaggacaagaagttgccgttgcgtgcgccacaaatcccatcacgcagggatggagattggtgaagcatgctactcaacgttaccggaagtttggaatgccaggagtaggtggagtattccacgatttagtgggaacattaaatccatggagtttcttctctaccacgactctggttttcatggcggtagtccttttcatcgtggacaaaagaatcttgattttggggatagcttgttatatgttttattttgtgcgagccgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 22 - protein, 3422 aa, Artificial Sequence
  synthetic
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGALTLRKIDNTIVLNVTQNDIGKTFPVRGGNCSININDAGYWCHNTVEYDCVTIAGTEEPDDIDCWCVGIEGVRVTYGKCSKSSPHGRRSRRAAVIPAHGGQGLSTHKETWLSTVAGERQIQRIERWIIRNPLYAAAMVTVAYFLGSDTKQKVLLAVLMLAIGPAYGSHCIGIERRDFVHGVQGSTWVNLVLDQGSCVTMVTENKPSVDVWLKEISLSQPTLVRRYSHTAKVHKTEIKAACPTMGEAKLDTEHNPSYECKRTYSDRGWGNGCGLFGKGSIIACAEFSSTGHMDVYEIDMTKIEYIVNSQIHGTVLVENNSQHAVESKFQPTTGGAEVTHAGYGTLGLDCHVQTMMDLNNFYLAVMGSDAWLVHKQWVEDLTLPWMAGETGHWKEKKYLVEFGEPHATKMEALVLGSQEGALRTALAGAMVVVYSQNDKKFTLKGGHVSCRARLTDLTLKGTSYPMCKGSLKFTKTPVDTGHGTAVMHVQVTKGAPCRIGVQMADNSNGGKSLGSMITSNPIVSTDGEETLVEVSPPYGESYIIVGSGDGKLVYHWHKTGSTIGSLFSETMKGAKRLAILGDDAWDFSSTGGVLASVGKMLHTVFGQAFHAIFGGLSWISKIILGCVMLWIGVNSRNGTLSVTLLTVGGILLFMTLGVNADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 23 - DNA, 11947 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcattaactctcaggaagattgacaacactattgttctgaatgtcacccaaaatgacatagggaaaacatttcctgtaaggggcggtaattgttccattaacatcaatgatgctggatactggtgtcacaatacagtcgaatatgattgtgtcaccatagctggtacggaagagcctgacgacattgattgctggtgtgttggcattgaaggagtgagagtgacttacgggaaatgttcaaagtcatcaccgcacgggaggagatctcgtagagcagcagtcattcccgcgcatggtgggcagggactatcaacccataaagagacatggctatccactgtagcaggggaaaggcaaatccaacgtatagaaagatggatcattcgcaatcctctttatgccgctgcaatggtgactgtggcgtattttctgggaagtgacaccaaacagaaagtgctgttagctgtgttaatgttggcaattggacctgcttacggctctcactgcattggaattgaacggcgtgactttgttcatggagttcagggaagcacatgggtaaatctagtgctggaccagggatcttgcgtgaccatggtgactgaaaacaagccaagtgtggatgtgtggctcaaggaaatctctttgagtcaacccaccttggttaggagatatagccacacagcaaaggtccataaaacagaaatcaaagctgcttgtcccacaatgggagaggccaaacttgatactgaacacaatccgtcgtatgaatgcaagcgcacttattcggatagaggttggggaaacggttgtggtctgttcggaaagggtagcatcattgcatgcgccgagttttcctcaacgggccatatggatgtttatgaaattgacatgaccaagattgagtacatcgtgaactcgcagattcatggaactgtgctcgttgagaacaattcccagcatgcagtagagtcaaagttccagccaacaacaggaggagctgaagtcacacatgcagggtatggcacacttggcttggactgtcatgtacaaaccatgatggatctgaacaacttctatctggctgtcatgggatccgatgcatggctagtgcacaagcaatgggtggaagatttgacattaccctggatggcaggtgaaactggacactggaaagaaaagaaatatctagttgaatttggtgaaccacatgccacgaagatggaagcccttgttttaggttcccaggagggggctttgaggactgcccttgctggagctatggtcgtggtgtactcccaaaatgacaaaaaattcactctgaaggggggtcatgtgagttgtagagcaagattgactgacctgacattgaaaggaacatcatatccaatgtgcaagggctccctcaagttcacaaagactccagttgacaccggacatggaacagcagtgatgcatgtgcaagtgacgaaaggggcaccatgcagaataggagtccaaatggctgacaactcaaatggaggaaagtcgttgggaagcatgattacatcaaacccaatagtctccactgatggtgaggagactctggttgaagtttctcccccatatggagaaagttacatcatagtgggatcaggcgatggcaagttggtttaccattggcacaagactggaagcactattgggagcctgttctcagaaaccatgaaaggagctaagagattggcaatcctaggtgatgacgcatgggacttctcctcaacgggaggggtcttagcctcagttgggaaaatgctgcatactgtgtttggacaagctttccatgcaatctttggagggttgagttggatttcaaaaataattctaggttgtgttatgttgtggataggtgtgaactcccgcaatggcacattgagtgtcaccttgttgactgttggcggcattctgttgttcatgacacttggagttaacgctgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 24 - protein, 3336 aa, Artificial Sequence
  synthetic
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGAAITIAPHGEAGLRVGSTKHWTSRATPQRYLMRVEKWVLRHPLPALVLVVLGWMMGRSHGQRAMYIVLMLLVAPSYGNQCLDVQSRDFVQGVSGGTWVDVVLDHDNCITIVADGKPSFDIRLSKMSMSKFAEYKRYCLQATMSDVTSIVACPGAGDAHNDKSKNHEYICKAVNNDRGWGNGCVLFGKGSMETCGKFECKKKMAGKLVARENVESVVTVHVHGASATDTKGVDTASTAKATITPKASVATLNLNDFGSLEVDCSTDVGMDFGEIVVADMSGKWWIVNKDWFNELALPWSTASTTAEVWQARDRLVEFGWPHAAKQNIYDIGDQEGAVTAAIAQAPMAKWESDKVELISGILKCKVKLGNLKLRGVTYSMCAQTFTTETRPADTGHGTVAFKVKYVGTDVPCRVPLHIIDSDGGVAAGRVITAHPFVMKQNDYIILEVEPPFGDSKIEIGTGTTKLVEAWHRKGSSIGNAFTATYKGITKLTVLGEHAWDFNSLGGFGASLGKAVHTLFGGVFRVMFGGMGWLTKIFVGAVLVWLGLGAHDKTIATTMILVGSILMYMAVTVGADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 25 - DNA, 11689 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcagcaatcacgatagccccgcacggcgaagcaggattgcgtgttggaagcaccaagcattggacttctagagcaactccacaacggtatctaatgcgcgttgagaaatgggtgctgcggcatcctctacctgctctcgtgttggtggtactgggatggatgatgggtcgttctcacggccagagggccatgtatatagtgctgatgctgcttgtggctccgtcatatggtaaccaatgcctggatgtgcagtcacgtgatttcgtgcaaggggttagtggtggcacctgggtagatgttgttttggatcatgacaattgcataaccattgttgctgacgggaaaccatcttttgatattcgtttgtcgaaaatgagcatgtctaaattcgcagagtacaaacggtattgcctccaggccacgatgagtgatgtcactagcatagtggcgtgtccaggggctggggatgctcataatgacaagagcaaaaaccacgagtacatttgcaaagctgttaacaatgaccgcggatggggcaatgggtgtgtcctttttggcaaaggatcaatggaaacttgtggtaagtttgaatgtaagaagaaaatggctggcaagttagtggcacgtgagaacgtggaatcagtggtcactgtgcatgtacatggtgcctccgcaactgacacaaaaggagttgacaccgcctctacagccaaagcgactatcacgccaaaagcttctgtggctactctaaatttaaacgactttggtagcctggaggtggattgttcaactgatgttggcatggactttggagagattgtggtggccgacatgtcaggaaagtggtggatcgtgaacaaggattggttcaatgaacttgctttgccgtggtccacggctagcaccactgctgaagtttggcaggcacgagacagacttgttgagtttggatggccacatgcggccaagcagaacatctatgacattggggaccaagaaggagctgtgacggctgccatagcccaggcacccatggcgaaatgggagtctgacaaggtcgagctaatctctgggattctcaagtgcaaggtgaaacttggcaacctaaagctgcgtggggtgacctatagcatgtgtgcccagacattcaccacggaaacaaggccggccgacaccggacatggcactgtggctttcaaggtgaaatacgtcggaacagacgtgccttgccgggtcccactccacatcatagacagtgacggcggagtggccgctggacgagtgataacggcacaccccttcgtcatgaagcagaatgattacattattctggaagttgaaccacccttcggtgacagcaaaattgagattggaacaggaacaacaaaactcgttgaagcatggcatcgaaaaggtagctcgataggaaatgcctttacggccacttacaagggcatcacaaaattgacagtgcttggagaacatgcctgggattttaattcactaggtgggtttggagcaagccttgggaaggcggtccatacactgtttggaggtgtattccgggtgatgttcggaggcatgggatggttaaccaagatctttgtgggtgctgtcctagtctggctaggattaggagctcatgacaagacgatcgccaccaccatgatcctggtaggatccatactgatgtacatggcagtgaccgtgggtgccgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 26 - protein, 3334 aa, Artificial Sequence
  synthetic
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGAVVIDMQVSTTRGTEIFEGETNRTDYLHLLKLPADGCWSGILVTKKCPKVTDLAKDLESTDCGSTWTEFTLRYRRCVVKKREKRSREPPKADLLAEMEIIAFKTIRENKTIFIVALLCVAIAKRWPTWVVILLAIGTWTTVKGEFVEPLYTLKAEQMTMLQTIVRPEEGYVVATPNGLLEFKTGPAEIYGGQWLRELLADCHVNASYSTDVCPGGSQLNMADIMAKERVCSTQPYNRGWGTGCFKWGIGFVGTCVELHCDRGFNVSSIARSAIVMNVTASFHSVSDTQQMVGDIPLTFRFAKLGNAAMTCRLESEQLLLDYYHVTGSSHEGLFLRSQVDSWPGVHSTASGRHGMEKVVVWGDARSNEILVKNVIEPSLSWEDAIATHGGFRDISFVCQIMLDKLVSGAFRDCPGPKISTFSQDGFGYSGVVITTLTASSNETCSLSLTCHGCLLQSTKMIFLAGKTTSRAFVKCGNHTSTLLVGSTSVSIECALNPISQGWRLARHVVDRYRRFGVSGVAGVWQDLVGKFSVGAFFSNTALLVILVLAALIDKRIAFLLVLGGYFYYVRADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 27 - DNA, 11683 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcagtggtgattgacatgcaagtttctaccactagaggcacggaaatttttgaaggggagacgaaccggacagactacttgcatctgctcaagttacccgctgatggttgctggagtggcatccttgtcacaaagaagtgcccaaaagtgactgacttggcaaaggacctcgagtcgacagattgcggatcaacgtggactgagttcacattgcggtatcggagatgcgtcgtgaagaaacgtgaaaagcgatcacgtgaacccccgaaagcggatttgctagctgaaatggagatcattgcgttcaagaccattcgcgaaaataagacaatcttcatcgtggccctattgtgtgtggctatcgcgaagcgttggcccacctgggttgtgattcttctggcaattggcacttggaccacagtaaagggggagtttgttgaaccgttatacacgctgaaagcggaacagatgaccatgctacagaccatcgtgagaccggaggaagggtacgtcgtggccacgccaaacggtctcctcgagtttaaaacaggaccggcggagatctacggggggcaatggctgcgcgagttactcgcagattgccacgtcaacgcatcctattcgactgacgtgtgtcccggtggatcgcagctcaacatggcagatatcatggccaaggaacgagtatgctcgacccaaccatacaaccgcggttggggcactgggtgcttcaagtgggggattggattcgttggaacgtgcgtcgaactccattgcgacagaggattcaacgtttcttctatcgctaggtcagctattgttatgaacgttacggctagcttccactccgttagtgacacacaacagatggttggcgacataccgctcacatttaggtttgcgaaactcggaaacgcggcgatgacctgcaggttggagtctgagcagttgctgcttgattactatcatgttacgggaagctcccatgaggggctgtttttgcggtctcaagttgacagttggcctggcgtgcactctactgctagtggtcggcacggcatggagaaagttgttgtgtggggagatgctaggtccaatgagattctagtaaaaaacgtaattgaaccttcgttgtcctgggaagacgcgatcgccactcatggtggattccgtgacatctcctttgtttgtcagattatgctcgacaaactagtcagtggagcttttcgagattgtccaggcccaaaaatatccactttttcccaggacggcttcgggtatagtggagtggtgataaccaccctcaccgcttcttctaatgagacctgttcgcttagcttaacgtgtcacggttgtctgctgcaatccacaaaaatgatctttctcgcagggaagaccacttctcgggcatttgtcaagtgcgggaaccatacaagcaccttgctcgttgggagcacttcagtttctattgagtgcgcccttaaccctatctcgcaaggatggcgcctagcccgacacgtggtggatcggtatcgacggtttggcgtgtctggtgttgcgggagtgtggcaggatctggtcggaaagttttcggttggtgccttcttctccaacacagcccttctggtcattctcgtcctcgctgccttgattgacaaacgcatagcctttctattggttttaggggggtacttttactatgtgcgggctgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 28 - protein, 3339 aa, Artificial Sequence
  synthetic
  misc_feature (558)..(558): Xaa can be any naturally occurring amino acid
  misc_feature (621)..(622): Xaa can be any naturally occurring amino acid
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGAKTMNGIMDKGEHVWKADWNVDFTNVKLPKDFCGSGIHVEKMCPQVDSLQDATIDCAGRHDQFLLSYTRCAAKNRVKRGEPGVVEPKVTNIWTITFNDELNSIIERVSGMLKNNRLMATAVICLVGAFKKWPTWLVVLLVLLPWTVVQASLADPFLILPKGDGLVKTRLYPGQISSISTHVGVLDISYMAVDIEEGRLVERLMSHCEVNGTYSQDCCALGCNLDLSKLNERNRACQTATYNRGWATGCPVFGLGSVATCVEVACSDSVEVSELTSQNIRIPLSLRLQHEELNVTMTTEAPVTSKFSHHGVVSISCQIGNPGFLAQQYVLSNGKHKAMFPISAVSGWPGIREIGGQYRNVDGSVKWGHVEANEIKVAAVYSDSIQWKTGIPIKTGIRDPLYLYCEVSLTDLTFKKIRACESPVEVSFMAGPTGLDGXLEIGLLEQVNKTCSITGSCEGCTLPHPTSVISTSDKKGHMHVECRTGTFTAIFGKQKFSFTCXXSYLRTIWATTAQAIGNYRKFGLDASGGPFLDLWNKIGPNFSRLEVVGILVVAALLIDKRLLLLLAIFGYVTYVRADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 29 - DNA, 11698 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcaaagaccatgaatggaataatggacaagggtgagcacgtttggaaagctgactggaatgttgactttaccaatgtgaagctccccaaggacttctgcggatctggaatacacgtggagaagatgtgtcctcaggttgattctttgcaagatgcaacaatcgactgcgcaggaagacatgaccaatttctcctgtcctatacacgatgtgcggctaagaatcgtgtcaaacgtggtgaacccggagtagtggaaccgaaagtcacgaacatatggaccataacgttcaatgatgagttgaacagcatcattgaacgtgtgagcgggatgctgaagaacaatcgattgatggcaacagcagtcatttgcttagttggggctttcaagaaatggcctacatggctcgtcgtgcttttggttttactgccttggactgtcgtgcaggcatcactggccgatcctttcttaattctgccgaagggtgatggtttggtaaaaactagattatacccaggacagatttcatcaatttccacacacgttggggtactggacatctcttatatggctgtggacattgaggaggggcgactcgttgaaaggttgatgtcacattgcgaagtaaatggaacttactcacaggattgttgcgctttgggatgcaacttggacttatctaagttaaatgagcggaacagggcctgtcaaacggctacctacaatcgcgggtgggctacgggatgtccagtttttggactgggcagtgtggccacatgcgttgaggtcgcgtgcagcgatagtgtggaggtgtccgaactgacaagccagaacatccggattcctctatctctacgtttgcagcatgaagagctgaatgtgaccatgacaacagaggcgccagttacttcaaagttctcacatcacggggtggtatccatctcttgtcaaattggcaatcctgggttcttggcacagcagtacgtgctgagcaatgggaagcataaagcaatgtttcccatcagtgcggtatcaggttggcctggaatccgtgagattggtggacagtacaggaacgtggatggctccgtcaagtgggggcacgttgaagcgaatgagattaaggtggccgctgtatatagtgacagcatccaatggaagactggaatcccgataaagacaggtattagagacccactgtatttgtactgtgaagtgtcgctaactgacttgactttcaagaaaataagagcatgtgaatcgcctgttgaagtttcgttcatggcaggacctacgggtttggatggtcgrctagaaattgggttgcttgagcaagtcaacaaaacatgctcaataacagggagctgtgaaggttgtaccttaccgcacccaaccagtgtcatttcgacttctgacaagaaaggccacatgcacgtagaatgtcgcacggggacatttacggcaatattcggaaagcaaaaattttctttcacctgtcrracwagttacctcagaactatttgggctacgactgcccaggcgattggaaattataggaaattcggactggatgcctcaggaggaccatttttggacttatggaataagataggtccaaatttctcccgtttggaggttgttggaatccttgttgtggcagccttgttaattgacaaaagactcttacttctcctggctatttttggatacgtcacatacgtgcgagctgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 30 - protein, 3343 aa, Artificial Sequence
  synthetic
MSKKPGGPGKSRAVNMLKRGMPRVLSLTGLKRAMLSLIDGRGPTRFVLALLAFFRFTAIAPTRAVLDRWRSVNKQTAMKHLLSFKKELGTLTSAINRRSSKQKKRGGKTGIAFMIGLIAGVGAVTIQVVVTTDARIELWSDRKNFTAHAHLVKVPTDVCNDGVFVTKHCPKVEKLSDLGEIDCGSSWSEFTLTYTRCVTLERASRAEEKGKTMLGQFKEDLSTLETEAFLLFKKHAFSTILVLLVLAIVMKWPVWVVVILGILAWNVVKGEFVEPFLVLKHDHSTMLMTRLYPGEIAHVATPAGLVDIRVSHAQIFGGQRFRELLSDCSVNASYSTDICPGGSQLDLESIKGPGRVCMTAPYNRGWGTGCFKWGIGAVATCVELNCTRETKVDLLTNSAIVANVTVNFHSTNDTKLLVPDTPITLKFGKLGTMTMTCRLGNDRIANDFYHVTDNIASGLFQKALIDAWEGPSKMANHISGHEKVVKWGHILPNEIKVSKIIEMELDWEKAITTHDGFSNTYFWCQVAVNKLVVGSFASCKSGAKASFIQSSWGFDGVVEVTLDEATKTICSLPLTCTGCSLLATKVVFLEGSQRAVGHVGCGNGTSMLTVGTTKVGIQCVVTPVSQIWNFVTHASGRYAKLGFGGVGGAFHDLLVKVGLTFTWDSWKIITVLSGLVVAFAIFDRKLVILIIILCGIAYTRADTGCAIDISRQELRCGSGVFIHNDVEAWMDRYKYYPETPQGLAKIIQKAHKEGVCGLRSVSRLEHQMWEAVKDELNTLLKENGVDLSIVVEKQEGMYKSAPRRLTATTEKLEIGWKAWGKSILFAPELANNTFVIDGPETKECPTQNRAWNSLEVEDFGFGLTSTRMFLRVRESNTTECDSKIIGTAVKNNLAIHSDLSYWIESRFNDTWKLERAVLGEVKSCTWPETHTLWGDGVLESDLIIPITLAGLRSNHNRRPGYKTQSQGPWDEGRVEIDFDYCPGTTVTLSESCGHRGPATRTTTESGKLITDWCCRSCTLPPLRYQTDNGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAAFFQMAYYDARQILLWEMPDVLNSLAVAWMILRAITFTTTSNVVVPLLALLTPGLRCLNLDVYRILLLMVGIGSLIREKRSAAAKKKGASLLCLALASTGFFNPMILAAGLVACDPNRKRGWPATEVMTAVGLMFAIVGGLAELDIDSMAIPMTIAGLMFAAFVISGKSTDMWIERTADISWEGDAEITGSSERVDVRLDDDGNFQLMNDPGAPWKIWMLRMACLAISAYTPWAILPSVVGFWITLQYTKRGGVLWDTPSPKEYKRGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPVPAGFEPEMLRKKQITVLDLHPGAGKTRRILPQIIKEAINRRLRTAVLAPTRVVAAEMAEALRGLPIRYQTSAVAREHNGNEIVDVMCHATLTHRLMSPHRVPNYNLFVMDEAHFTDPASIAARGYISTRVELGEAAAIFMTATPPGTSDPFPESNAPISDLQTEIPDRAWNSGYEWITEYIGKTVWFVPSVKMGNEIALCLQRAGKKVIQLNRKSYETEYPKCKNDDWDFVVTTDISEMGANFKASRVIDSRKSVKPTIITEGEGRVILGEPSAVTAASAAQRRGRIGRNPSQVGDEYCYGGHTNEDDSNCAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKSFKDFASGKRSQIGFIEVLGKMPEHFMGKTWEALDTMYVVATAEKGGRAHRMALEELPDALQTIALIALLSVMTMGVFFLLMQRKGIGKIGLGGVVLGAATFFCWMAEVPGTKIAGMLLLSLLLMIVLIPEPEKQRSQTDNQLAVFLICVLTLVGAVAANEMGWLDKTKSDISGLFGQRIETKENFSIGEFLLDLRPATAWSLYAVTTAVLTPLLKHLITSDYINTSLTSINVQASALFTLARGFPFVDVGVSALLLAAGCWGQVTLTVTVTSATLLFCHYAYMVPGWQAEAMRSAQRRTAAGIMKNAVVDGIVATDVPELERTTPIMQKKVGQVMLILVSLAALVVNPSVKTVREAGILITAAAVTLWENGASSVWNATTAIGLCHIMRGGWLSCLSITWTLVKNMEKPGLKRGGAKGRTLGEVWKERLNQMTKEEFIRYRKEAITEVDRSAAKHARKERNITGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTLRVLEMVEDWLHRGPKEFCVKVLCPYMPKVIEKMELLQRRYGGGLVRNPLSRNSTHEMYWVSRASGNVVHSVNMTSQVLLGRMEKKTWKGPQYEEDVNLGSGTRAVGKPLLNSDTSKIKNRIERLRREYSSTWHHDENHPYRTWNYHGSYEVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGRIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLSENGEERLSRMAVSGDDCVVKPLDDRFATSLHFLNAMSKVRKDIQEWKPSTGWYDWQQVPFCSNHFTELIMKDGRTLVTPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRSIIGDEKYVDYMSSLKRYEDTTLVEDTVL

SEQ ID NO: 31 - DNA, 11710 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcagtgacaatccaagtggttgtcactactgatgcacgaatcgagctttggtctgaccggaagaactttacagctcacgctcacctcgtcaaggttcctaccgacgtttgcaatgatggggtgtttgtaacaaaacattgtcccaaagttgagaagttgagtgaccttggcgaaatcgattgcggttcatcatggtctgaatttaccttgacttacacacgatgcgtaaccttggaaagagcctcacgtgcggaagagaagggaaagacaatgctggggcagttcaaggaggatctttccaccctggaaactgaggcttttttgctgtttaaaaaacatgcgttctcgaccatcctggttttgctagtattggccatcgttatgaagtggcccgtgtgggttgtggtaatactggggattctagcgtggaacgtcgtgaaaggtgagtttgttgagccattcttggttttaaaacatgaccacagtactatgctcatgaccagactgtacccaggagaaatcgctcacgttgcaactcctgccgggttggtggacattcgtgttagccatgcccaaatttttggaggtcaacgctttcgtgagttactgagcgactgctctgtgaacgcttcgtattcgaccgacatatgccccggaggatcacaacttgacttggaatcgatcaaaggtcctggacgtgtctgcatgaccgctccgtacaatcgaggatggggaaccggatgtttcaaatggggaattggagctgttgccacgtgcgttgagttgaactgcacacgggaaacaaaagttgatttgttgacaaattctgctattgtggccaacgtgacagtcaatttccactcgaccaatgacactaaactccttgtgcctgacaccccaattacgttgaagtttgggaagttaggaacgatgacaatgacgtgtcgtttgggaaatgaccgcattgctaacgatttttaccatgtaactgacaatattgcatctggactgttccagaaagctttgattgatgcgtgggaaggaccctccaagatggcgaaccacattagcggacatgaaaaagtcgtgaagtggggtcacattctcccaaatgagatcaaggtcagcaagatcattgaaatggagttagattgggaaaaggcgatcaccacacatgatggattttcgaacacctatttttggtgtcaagtggccgtgaacaagttggtcgttgggtcatttgcctcatgcaagagcggagcgaaggctagcttcatccaatcctcgtggggttttgatggtgtggttgaagtgactttggatgaggccaccaaaaccatttgctccctacccctgacatgtaccggatgtagcttgttggctacaaaagtggttttccttgagggaagccagcgggctgttgggcacgtggggtgtggaaatggaacatcaatgttgacagtaggaacgacaaaggttgggatccaatgtgtggtcacaccggtgtcacaaatttggaacttcgtgactcacgcttccggacgatatgcgaaacttggttttggaggagttggaggagctttccatgatctgctagtgaaggttggattgaccttcacctgggattcatggaagatcatcaccgtgttgtctggtctcgtagtggcttttgccatctttgatcggaagttggtgatcctgatcattatcctctgtggaatcgcttatacccgagctgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 32 - protein, 3436 aa, Artificial Sequence
  synthetic
MVTKLRRPVKRAVDMMRRAVPRAAGPRRVLTRVSNTVKRNAGALRALLAYLLYQTFSGRKVGSGARSALKRFNKNDIVKMLLAFRRTLTNIITTMQRRVKGKKRRGVQDVPLLVLLLVGAGAMAATLRTVGDLTWLNVSTTDVGKWIRVENRHGKGECFVTATDVGTWCSDSVGYECPQIAPAYDPEDLDCYCRNTSTYVTYGRCKNGRSGRSRSKRAITIAPHGEAGLRVGSTKHWTSRATPQRYLMRVEKWVLRHPLPALVLVVLGWMMGRSHGQRAMYIVLMLLVAPSYGNQCLDVQSRDFVQGVSGGTWVDVVLDHDNCITIVADGKPSFDIRLSKMSMSKFAEYKRYCLQATMSDVTSIVACPGAGDAHNDKSKNHEYICKAVNNDRGWGNGCVLFGKGSMETCGKFECKKKMAGKLVARENVESVVTVHVHGASATDTKGVDTASTAKATITPKASVATLNLNDFGSLEVDCSTDVGMDFGEIVVADMSGKWWIVNKDWFNELALPWSTASTTAEVWQARDRLVEFGWPHAAKQNIYDIGDQEGAVTAAIAQAPMAKWESDKVELISGILKCKVKLGNLKLKGTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSGSSIGNAFTATYKGITKLTVLGEHAWDFNSLGGFGASLGKAVHTLFGGVFRVMFGGMGWLTKIFVGAVLVWLGLGAHDKTIATTMILVGSILMYMAVTVGALSEIGCSLDISRKEMKCGDGVFIFREAGMWKDGYAFHPSEPKSLAASVLKSWQSGVCGVRSTNRMEHAMWKQIENELNGILEENEAQLSVVVRESNGTFPRGERRMHVAEPLRYGWKTWGKTAISTVPLAKETFVVDGNDEGECPSQMRAWNSFQVEEFGTGLVKTKVFLDISTALTAQCDTKMLGAAIKGNRSVHGDPGLWMVSAEIDGTWQIIELTLAESRRCTWPDSHTVWGRNVQESELILPPSFGGPMTNMNKRKGYATQVGGPWNHVPLRVVFEECPGTTVSVEPNCTRRSDSVRSTTDSGKIITDWCCRSCTMPPLTYRTPDGCWYAMEIRPKNVKEESLIRSHVAAGVFKGIDDVSLGLLVMIIFLQEGLRRKLTATYIMWAALVVLIAGILGELTVRDVLRYLILVGTAFAESNNGGDLIHLALVAVFKIRPAFLFGFLFRSQWSPREGVLLASGALMLQIASECLHASAIMQVVDSLSMGWLMIRAIAVPGMTSKAMPLLCACIPAVTSLLAHSTRAGIITMAGMSLIAGSKGSSVKKHSPYMLALVVAGLGARPIGMLAMEAFSHLKGRRSWPAGEMMSAVGLTCALVGAISGASSQDFAGPLAAAALIIIAYAISGRSADVYLEKAGEISWSEDAKISGSSPRIDVCVTENGDFKLRHESEATWTRNCVLAACLVVAGVHPLGIPVAGLMWFGYVKSNKRGTVLWDIPSPQATSAPTVEDGCYRVMSRRLLGSTQLGVGIMLDSTFHTMWHITRGASIVSGEGRLDPYWADVKEDLVCYGGPWKIRNTWDGLSEVQLIAVAPKENPVNVQTMPGKFIVANGGEIGAVVLDYPPGTSGSPIVDQQGNVIGLYGNGVMINDQTYASAIAQAPAEVARTPTWFTDDMLRKGQLHVLDLHPGAGKTRKVLPEILKAAVEKRLRTLVLAPTRVVAKEMHEALTGLPVRYQTSAVAPNGSGGELIDVMCHATYTHRQLTPGRGVNYQLYIVDEAHFTDPASIAARGIIATRVRLGHAAAIFMTATPPGMSNPFPESNAHIEDEEREVPTKAWNAGYEWITDYGGKTVWFVPSIRMANTIAACLVRAGKTVIVLHSGSFNEEYQKTKSGNWDFVVTTDISEMGANFKASRVIDSRLSIKPMFSYAPSERVVIGSPRAVSPASAAQRRGRVGRDPRQLGDQYIYGGPVGEDSAEFVHWKEARILMDNVTVPGGLYPQFYEPEGGMCDAMDGAHRLTDAKREVFRDLMKKGELPVWLAYQVAQAGHAYTDRTWCYGGPADHQVYDDCGQTVDYRSLNGERRMLRPKWLDQRTYNDKTSLRLFTEFAEGRRRYSELMDVFGRMPQHMLDRTILAADTFKDVLTATPGSRVHRLALDNLPEATETMMVVGILSVSTLGVMLFLMSPKGMTRMTCGLVVIILATYFLWVSGMAGYQIAAMQLIAFILFVVLVPEPGSQRSVQDNTIAIILIVILSLAAIIAANEAGLLEKTKKDFAWKRESHVLVTPSPWNLDFSMDLRPATSWSLYVVMATMLGPVLEHAIVTNYASVSLTAITNQAGILLSMDKGTPFWNLDWSVVLLCVGSWSGINGTTLMVASTMTVLHFAMILPGIRAKAAREAQNRTAAGVSKNPLIDGLNTINIQPLPEMDPMYERKMGLWMLIAVAGAAVVFDKRMLHYTEFGVLGSAAVSPLIEGYASAVWNTSVAASVCNLMRGHYMAGIPMAYSLIRNLSMKGVPRRGLQATHTLGMVWKHKLNAMDKAAFNAYRKDGVTEVDREPAREAMKKGDLVSGWAVSRGSAKLRWMHERGYIPLQGVVIDLGCGRGGWSYYAAAQRRVTAVKGLTKGGPGHEEPINVQSYGWNLVTFRSGVDVFHTEVQPADTLLCDIGESSADPAVEKARTVQVLVNFERWIRESRCEHFCCKVLGPYSPEVMERLDRLTKTYGGAVIRNPLSRNSTHEMYWVSGAKGNPVNAITATSRVLIERMYRRLGKSYWEEDVNLGTGTRAVSCAAEKPDLAKIGRRIELLKKEYKASWFEDPEHPYKTWTYHGSYETKTTGSSSSMINGVVKEITHPWDTNPRVTTVCMTDTTPFGQQRVFKEKVDTKAREPSQGTREIMRIVSKWLTLYIGRSKRPRLCTADEFIAKVNADAALGTMFDSQGNWANAKEAVRDPRFWQLVAKERELHLRGQCATCVYNMMGKREKKLTEFGKSKGSRAIWFMWLGARFLEFESLGFLNEDHWLSRENSGGGVEGIGLQYLGYVLKEMALIPGGKMYADDTAGWDTRITNADLEDEMDILGLMDPHHKKLAKNLMELAYNNKVVRVMRPGKGGKTLMDIISRKDQRGSGQVVTYPLNTWTNLKVQLIRMAESEGVLDPKEIDGITVTTRNNLEKWLTSQGAERLKRIAASGDDVVVKPVDERFANALTYLNDMAKIRKDISEWKPSAGWFHWEEVPFCSHHFHQLVLKDGRTLVVPCRDQDELIGRARVSPGAGWTIRETAGLSKAYAQMWLLMHFHRRDLRMAGFAICSAVPSDWVPTGRTSWSLHAKGEWMTTEDMLAVWNRVWIEDNPHMSNKTLVGSWQDIPYQRKSLDIHCGSMIGQRSRSTWAANIRISIGHVRRLIGTTEKYLDYMQEQERFKIAEPTRLGNVI

SEQ ID NO: 33 - DNA, 11815 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctgccactttacgcaccgttggagacttgacatggctaaatgtgtcaaccactgatgttggaaagtggatacgtgtggagaataggcacggcaaaggagagtgtttcgtcacggccactgacgttggaacatggtgctcagactctgtgggatatgaatgtcctcaaattgcaccggcgtatgaccctgaagacttggattgctactgccgaaacacctcaacctacgttacttatggaaggtgtaaaaatgggcgcagtggacgatctcgcagcaagagagcaatcacgatagccccgcacggcgaagcaggattgcgtgttggaagcaccaagcattggacttctagagcaactccacaacggtatctaatgcgcgttgagaaatgggtgctgcggcatcctctacctgctctcgtgttggtggtactgggatggatgatgggtcgttctcacggccagagggccatgtatatagtgctgatgctgcttgtggctccgtcatatggtaaccaatgcctggatgtgcagtcacgtgatttcgtgcaaggggttagtggtggcacctgggtagatgttgttttggatcatgacaattgcataaccattgttgctgacgggaaaccatcttttgatattcgtttgtcgaaaatgagcatgtctaaattcgcagagtacaaacggtattgcctccaggccacgatgagtgatgtcactagcatagtggcgtgtccaggggctggggatgctcataatgacaagagcaaaaaccacgagtacatttgcaaagctgttaacaatgaccgcggatggggcaatgggtgtgtcctttttggcaaaggatcaatggaaacttgtggtaagtttgaatgtaagaagaaaatggctggcaagttagtggcacgtgagaacgtggaatcagtggtcactgtgcatgtacatggtgcctccgcaactgacacaaaaggagttgacaccgcctctacagccaaagcgactatcacgccaaaagcttctgtggctactctaaatttaaacgactttggtagcctggaggtggattgttcaactgatgttggcatggactttggagagattgtggtggccgacatgtcaggaaagtggtggatcgtgaacaaggattggttcaatgaacttgctttgccgtggtccacggctagcaccactgctgaagtttggcaggcacgagacagacttgttgagtttggatggccacatgcggccaagcagaacatctatgacattggggaccaagaaggagctgtgacggctgccatagcccaggcacccatggcgaaatgggagtctgacaaggtcgagctaatctctgggattctcaagtgcaaggtgaaacttggcaacctaaagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggtagctcgataggaaatgcctttacggccacttacaagggcatcacaaaattgacagtgcttggagaacatgcctgggattttaattcactaggtgggtttggagcaagccttgggaaggcggtccatacactgtttggaggtgtattccgggtgatgttcggaggcatgggatggttaaccaagatctttgtgggtgctgtcctagtctggctaggattaggagctcatgacaagacgatcgccaccaccatgatcctggtaggatccatactgatgtacatggcagtgaccgtgggtgccctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaaggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatct

SEQ ID NO: 34 - DNA, 11797 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaaccgtaaaatccgtacgcttgttttggcacactagtttgtgacataaggcttttgtcgcgcgtattgggtttaactttttttcgagaaatcgagaggtaagaagaattgaaagacattatgtctaacccttccgtcaggaggggtgtcaatgtgatggcggctcagaaaaaacgagtcgcccaaaaaataaaatcaatgaggaagggaacccagagcatcagcaatggagttaggggtttcatcctctttttcatatcccaaatcttctgggcacgtaagatcacgcccagagtgaaaggattgtggaaaaaactagacaaatttcaggcaatgaaggttttgaaagggctaaggaacatcatcaatggattgatgagatcggtcgctgggaaaaagaaacgccgtggagggaataccgtgccattcttagtgatgatgatggtagcaacaacatgggccttaactctcaggaagattgacaacactattgttctgaatgtcacccaaaatgacatagggaaaacatttcctgtaaggggcggtaattgttccattaacatcaatgatgctggatactggtgtcacaatacagtcgaatatgattgtgtcaccatagctggtacggaagagcctgacgacattgattgctggtgtgttggcattgaaggagtgagagtgacttacgggaaatgttcaaagtcatcaccgcacgggaggagatctcgtagagcagcagtcattcccgcgcatggtgggcagggactatcaacccataaagagacatggctatccactgtagcaggggaaaggcaaatccaacgtatagaaagatggatcattcgcaatcctctttatgccgctgcaatggtgactgtggcgtattttctgggaagtgacaccaaacagaaagtgctgttagctgtgttaatgttggcaattggacctgcttacggctctcactgcattggaattgaacggcgtgactttgttcatggagttcagggaagcacatgggtaaatctagtgctggaccagggatcttgcgtgaccatggtgactgaaaacaagccaagtgtggatgtgtggctcaaggaaatctctttgagtcaacccaccttggttaggagatatagccacacagcaaaggtccataaaacagaaatcaaagctgcttgtcccacaatgggagaggccaaacttgatactgaacacaatccgtcgtatgaatgcaagcgcacttattcggatagaggttggggaaacggttgtggtctgttcggaaagggtagcatcattgcatgcgccgagttttcctcaacgggccatatggatgtttatgaaattgacatgaccaagattgagtacatcgtgaactcgcagattcatggaactgtgctcgttgagaacaattcccagcatgcagtagagtcaaagttccagccaacaacaggaggagctgaagtcacacatgcagggtatggcacacttggcttggactgtcatgtacaaaccatgatggatctgaacaacttctatctggctgtcatgggatccgatgcatggctagtgcacaagcaatgggtggaagatttgacattaccctggatggcaggtgaaactggacactggaaagaaaagaaatatctagttgaatttggtgaaccacatgccacgaagatggaagcccttgttttaggttcccaggagggggctttgaggactgcccttgctggagctatggtcgtggtgtactcccaaaatgacaaaaaattcactctgaaggggggtcatgtgagttgtagagcaagattgactgacctgacattgaaaggaacatcatatccaatgtgcaagggctccctcaagttcacaaagactccagttgacaccggacatggaacagcagtgatgcatgtgcaagtgacgaaaggggcaccatgcagaataggagtccaaatggctgacaactcaaatggaggaaagtcgttgggaagcatgattacatcaaacccaatagtctccactgatggtgaggagactctggttgaagtttctcccccatatggagaaagttacatcatagtgggatcaggcgatggcaagttggtttaccattggcacaagactggaagcactattgggagcctgttctcagaaaccatgaaaggagctaagagattggcaatcctaggtgatgacgcatgggacttctcctcaacgggaggggtcttagcctcagttgggaaaatgctgcatactgtgtttggacaagctttccatgcaatctttggagggttgagttggatttcaaaaataattctaggttgtgttatgttgtggataggtgtgaactcccgcaatggcacattgagtgtcaccttgttgactgttggcggcattctgttgttcatgacacttggagttaacgctgagtacggttgctcattggacttccaaaggaaagaactgaagtgcggcgatggagttttcgtgttcaatgatgccaatgattggttgaccaagtacagatatcatcctgaagacccacgaacattggcttctctggtcaaggcttcatataaggccggacggtgtgggcttggatcagttgacaacatggaacataagatgtgggtgtccctggaaaatgagttgaatgccatctttgaggaaaaccaagaaaatatctcagtggtagtgaaggagagtaatggaatataccccaaaggaaattatccattcactggcactccagaaaagctgaaatatggatggaaaacatgggggaagaaattggtatttgccccggttttgagtaacaacacctttgtaatagatggaactcccgatgattgtccttacagcaacagagtttggaattcatttgagattgatgagttcggagcaggtttgactcataccagggtgtttttgaaacaaagactggaaagaaaagaagagtgtgacaatgcacttttaggagctgcagccaaaggggacgtggcagtccatggggatcccaacttctggatggcctcaaacaaaactggagaagtgtggcagatcaatgaattaatgtcactaaacctcaagcactgcacatggcccttgtctcatacgttgcatggcaatggagttctggaatcagacatgttcgttccgaaaagcattggaggaccggttagtcaccacaacttcattaaaggctacaaatctcaggtaaatggaccttgggcatcagtgcctctagaaatgcatcggagagagtgccctgacacagtggttcaaatagatcagaactgcagcgggagaggcaagtccacacggagcactacaaaggaagggaaaataatccgggattggtgttgtcgaaactgcacgctgccccctgttagctttgatggtcctgatggatgctggtatgctatggagattagaccgcagaagatgaatgaaaaacatttggtcacttcatgggtaagtgccggtgacgggatggaaaatggtaacattggattggtggctctctttgtgtgctttgacatgttcttgaagaacaagaacacccgaaagattagcttggttggagccttgtgtctattgggcgcaatgatccttgggaatgttggatttgttgatctaataaaattcatgattgtggttggtgaacatttccgctccttcaaccatggaggtgacgtctcctacttggtcctgaccgctgtctttgacatcaggccagccctgctctgcggctttgtgctgcgcaagaaatggagtcctagtgagagagtagtcatggccattggaatgatgctcctgcaaacggtgtgtggggattggactcagacatcttggtgggaatggctggatgctgttggattggggctcttgatcctcaatgcagtagctttacaaagatggaaaccggccattttggtcttgctgacaatgttgactccgctgaatatgcgagtaattcaaggtgctgcagggggagtgtgtggcgttatggtggccatgtctttgtggaaaacagaaggaagaagtctccgtaagagttacctgccagtcattggctatgttgcttcggcttttggatgggggtattcatggatcatggcagtgtacatcatgtgggcaacccatgtgtcaaggagatcttggcctgtaggagagctggcagcagcaattggacttttgggagctgcaatgggaatggcatccacaaaggatggagccatggtcatgccaatagctgtgctcggattaatcatggtgatcataggaatgacaggcaaatgcgatggaatggagattcgcaaagttgggtgtgtctcgtgggaagactccgctgagatcagtggttcaagctccaggtatgacgtggctcttagtgatggcggagaattccagctgttagagaattcgcggcccccctggaatcacatcattttcctcaccctgggaatgctggcgtcagcagtgcatccaatagtactgggtgtggtcatacttgcctgggggtggtttgcaggcaaaagccagcgcagtggagttttgtgggacgtgcctgttgctccaaaagttgaggaccatggaccccttgaggatggaatttacaccattttccagaatggattgtttgggagctcccaggctggagtaggagtggctcagggaggcgtgtttcacactatgtggcacgttactcgtggaggaatcctgctgcacaaaggtaaaagactcacccctggttgggctagtgtgaaaagtgacctcatttcgtatggaggtaaatggagacttgatggaagttgggatggagtcgaggaagttcagttgattgctgtccctcccaggaaaaatcctatcaatgttcaaactaagcccagcattttcaaattaaagagtggagaggagatgggagccatagctttggattaccctagtggaacttcaggatcacccattgtcaacagagctggagtcgttgtggggttgtatggaaatggaattgtgctcaatcagggtggttatgtgtcagctattagccaagcagctgtggaagaggtcagtagagatgagctacccggaattgaaggctacctgagaaaggggcaactcaccgttctggattttcacccaggggcaggaaagacacgtaacttcctgccccaaatcttgaaggcatgcaggacccgcaagttgcgaacactagtgctggccccaaccagagtggttctgagcgaaatgaaggaagctctgaatgatcacgatgtcaagtaccacacacaagctttctcatctgccagttcaggacgtgaactgattgacgctatgtgccatgcaacattggcatatagactattggaaagcactagggtgataaactgggaggttgtgataatggatgaggctcactacatggatccagccagcattgctgtgaggggttgggctgcccatagagctagagctcatgaatgtgcaacaatattcatgtcagcgactcccccagggactgcaaatgaatttcctgaatcaaatggaggcattgaggacatccgcaaggacatccccagtgaggcttggaacaaaggtcatgagtggatcctagaggatagaaggccaacggtgtggttcctgccctctataaggagcgcaaataacattgctgcatgtttgaggaaagccaacagaacggttgttgtgttaaacagacagacctttgaaagtgtgtaccccactatcaagacaaagaaaccggacttcatcctagccacagacattgctgagatgggggcaaatcttcatgtggaaagggtaattgactgccgaactgctttcaagccagtgctcagtgaggatcaggaacgggtaacactgaaagggccaatgagaatatcagcttctgcggcagctcagcgaagaggccgtgtggggagagatccatccagagagtctgacacatattactatggagaggacacctcagaggacaatgaccatttggtgtgctggactgaggcgtctatgattctggataacatggaaattaaagggggaatggtggctccgctgtacagcgtggaagccacaaagaccaaaatgacgccaggtgagtgtaggctaagagatgatcaaaggaaaacttttagagcattaataaagaaacatgagctgcctgtgtgggtctcatggaaggtggccaaagcaggaatcactccagatgataggaagtggtgttttgatggagaggaggacaacaccgtgcttaatgacatgggggagaaggtcatgggaagaagcccaggaggtgcaaagaaagctttgtgccctaggtggtcagacgcaaggctgactagtgacaatgcttccctcatgaacttcctggcatttgccgaggggaggagatcatacatgaggatcgttgacgctctcatcatggtgccccctatgctgaaagaaaaggtggtggatgcagcggacaccttagcactactactgcgttccgaggagggcagcagggcctacaaacttgctcaggagagcgctccagaagcgatcacaacactcatcatggtaaccttcctggttctgctatcagcaggactggttctgatgctcatgtggccaaaagggattagcaagatgtcattgggcatgctcaccatgagcgttgcgggataccttcttttggaaggagggctcacccaagtgcaggttgcaggaatattgctggtgtttttcatcttgatggtggttctaatccctgatgatggctcccagaggtcaatcaacgacaacaagctggcttacatgatgacaggaattatccttcttgttggagctgttgctgctaatgagatgggatggcttgaaaaaacgaaacaggatttgtttgggaaaagggaagaaatgccgggatggaactgggatttgggacttgacctaagacctggagcagcctggaccacttatgtggctctggcgactgtccttggcccagtgatagaccattggatacaagtggaatatggaagcgctagtttgactggcatagccaattcagcaggcatttccgcatttctggacaagggggttcctttcatgaaggtcaacatggcagtggtggttctgtttgtgagcgcatggaatagctattccatgctggccatcatggagggttgcctgatggcaggcattcatttttgcctgttaatccctgggctgaaggcaagagcaatgaagaaggcccaaaagaggatctatcatggtctatctaagaatccagtagttgatggcacacccactgtggatattgaagaagctgaagaaactccagtactgtatgagaagaaagtggctttggcactgctgggagttgtggctgcgctcaatggaattgtggtcagaacacctttctccatggctgaatcaattgtgctggggagtgccttggtgggtccttttattgagggtaacacgtctccactttggaacgcccctatcgcggttgcgttcgctggtctaatgcggggacattatagcagcatgataggattggcctacaatttttggatattgcaaaaccccaaaagaggaggtggtgagaccatgacccttggccaggtgtggaaaaagagactgaacatgcttgacaagaaggagtttgcaaaatacaagatttcagacattcatgaggtggaccgtaggcaagcacgtaccattctggacgcaggcatcaccaacgttggagtcagcgtgtcaagaggaacatccaagctgaagtggctgacagacagagggtactttaagccagaaggtagggttgtggatctcgggtgtggccgtggaggttggtcatacttggctgctgcagcaagagaaaccctggaagtgaaagcttacactctaggtgtgtcagggcatgagcgaccaattcaaatccaaagcctgggatggaatgttatcaagtttaaggacagagttgatgtgcacagacttccaatcgcccaatgtgacacagtgatgtgcgacattggagagtcttccagctcttgggaacaggagcgagagagaaccctgagggtaattgacctgatggagaactgggtggccaagagcagacccaaatactgcttcaaggttttggctccctactcctcagaagtgattgagcgtctggaactgtttcaaagaagatttggtggcgggataatcagggttccactctcacgcaactcaacccatgagatgtactacactagtgaggtcaccaataacattgtgcacatggtgaactgcgtctcaagattgctgctccggagaatgaccaaccccagtggaatagccatcttagagccagatgtggtttttccaacaggaacacgcaatgtcaagggggacttgggccccttggacatggagaagatcaagatgcgtgtatccaagttaaaaaaggagaacttggacacatggtggcatgatgaaaatcatccatacaggacctggcattaccttggaagctacgttgctaaacagagtggcagcgcagccactatggtcaatggaatagtcaagctactgagcatgccatgggataggattgaggatgttactgccttggccatgacagacacaacaccatatggacagcaacgtgtgtttaaggaaaaggttgacactagggctccaccccctcctccagggactaggaaaatcatgagcattaccaacacatggctctttgatttccttggccgaagcaaacaacctagactgtgcaccaaagcagagtttatagcaaaagtcagatcacacgctgccataggcaacatgttggaggagcaggaaggctggaaaaatgcagctgaggcagtgaatgatccaagattttgggaattggttagtgaagagagggagctacacttacaaggaaaatgctccacatgcatctacaacatgatgggaaaaagagagaagaaacccgctgaattcggacgtgccaagggaagcagagccatatggtacatgtggctcggagctaggttccttgaatttgaggccctgggtttcctcaatgaagatcattggttctccagagacaactccaagggtggtgttgaggggatgggcttgcagtacctaggctatgttgtggaagatgtgtggaagaaggggaatggaatcatgtatgcggatgacacagctggatgggacactaggataacagaggctgatttggaggatgaacaatacctgcttgaaaagatgagtggcactcacaagaaactggcttgggctattacagagttgacctacaagaacaaggtcgtcaaggtccctagacctggacctggaggaaagattctgatggatgtgattgccaggagggaccaaagaggttctgggcaggttgtcacctatcccctcaacactggaacaaatctcaagacacagttaataaggatggctgaaggcgagggcataatcaccccagaggacacactccaactcagtcacaagaatgagaaaaatttgagggaatggttgtgcacccatggtgctgaaagacttggtagaatggctgttagtggtgatgattgcattgttgcgccaattgatgagaggtttggcaacgccctaagtcatctcaatgccatgtcaaagattagaaaggacattgatgattgggagcccagcaagccttggatgaaatgggaggaggtgccattctgctcccaccatttccaccatttgctactgaaggatggcagaagaattattgttccatgccgaaaccaagatgagctgattggaagggcccgagtgtcaccaggaaatggatggatgatcaaagaaactgcatgccacagcaagtcctatggtcagatgtggctcctcatgtatttccataggagggatctgagattgatggctaacgcaatatcatcatgcgttcctatcaattgggtgccaactggaagaactacatggtcacttcacgctggaggagagtggatgacctccgaggacatgctggaagtgtggaacagagtttggattttggacaatcctcatatgagtgacaagtcagtaatcctagagtggagagatgttccatatctggcaaagagtgatgatatcaggtgtggatcattgatagggacatcacagagagcctgctgggcagctaacatccgttctgtggttgagaaaatcaggcatttggtgggagatgagaagtacaaagactacctgcactccatggacagatatgccctggaacactccgaaattggctgcttgatataaattaaagcactccattaaaccaaccaaacactccttcatcaaacaacactccatatttaaagtgtcaggccgggaaaccgccatggctaagctctgaggccatgcagtctgggagagcagcacattcttgcccacagttgtgcttaattacatttttgggagcctccctttgtcatgcgatgcatggtggcaaagcgacgaggactagtggttagaggagaccctccctgggctatgcatcaagtcggaccgtttctacgggaagctgtaaaccgtactgtccgtgacagcattccgaaaggttgggcgaagctgtaagcctgtaaaactttggagcctccgctctgcgacccgtgtaagcagagtcgatggggactagtggttagaggagaccctccacagcaaacaacacacacggatcacattgacaccagggatagaccggagattcttcttgcctctcgacagctttaggcaccgattgccaaactacgaagctgtcgagaaacgacaagaatct

SEQ ID NO: 35 - DNA, 11806 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctgccactttacgcaccgttggagacttgacatggctaaatgtgtcaaccactgatgttggaaagtggatacgtgtggagaataggcacggcaaaggagagtgtttcgtcacggccactgacgttggaacatggtgctcagactctgtgggatatgaatgtcctcaaattgcaccggcgtatgaccctgaagacttggattgctactgccgaaacacctcaacctacgttacttatggaaggtgtaaaaatgggcgcagtggacgatctcgcagcaagagagcaatcacgatagccccgcacggcgaagcaggattgcgtgttggaagcaccaagcattggacttctagagcaactccacaacggtatctaatgcgcgttgagaaatgggtgctgcggcatcctctacctgctctcgtgttggtggtactgggatggatgatgggtcgttctcacggccagagggccatgtatatagtgctgatgctgcttgtggctccgtcatatggtaaccaatgcctggatgtgcagtcacgtgatttcgtgcaaggggttagtggtggcacctgggtagatgttgttttggatcatgacaattgcataaccattgttgctgacgggaaaccatcttttgatattcgtttgtcgaaaatgagcatgtctaaattcgcagagtacaaacggtattgcctccaggccacgatgagtgatgtcactagcatagtggcgtgtccaggggctggggatgctcataatgacaagagcaaaaaccacgagtacatttgcaaagctgttaacaatgaccgcggatggggcaatgggtgtgtcctttttggcaaaggatcaatggaaacttgtggtaagtttgaatgtaagaagaaaatggctggcaagttagtggcacgtgagaacgtggaatcagtggtcactgtgcatgtacatggtgcctccgcaactgacacaaaaggagttgacaccgcctctacagccaaagcgactatcacgccaaaagcttctgtggctactctaaatttaaacgactttggtagcctggaggtggattgttcaactgatgttggcatggactttggagagattgtggtggccgacatgtcaggaaagtggtggatcgtgaacaaggattggttcaatgaacttgctttgccgtggtccacggctagcaccactgctgaagtttggcaggcacgagacagacttgttgagtttggatggccacatgcggccaagcagaacatctatgacattggggaccaagaaggagctgtgacggctgccatagcccaggcacccatggcgaaatgggagtctgacaaggtcgagctaatctctgggattctcaagtgcaaggtgaaacttggcaacctaaagctgcgtggggtgacctatagcatgtgtgcccagacattcaccacggaaacaaggccggccgacaccggacatggcactgtggctttcaaggtgaaatacgtcggaacagacgtgccttgccgggtcccactccacatcatagacagtgacggcggagtggccgctggacgagtgataacggcacaccccttcgtcatgaagcagaatgattacattattctggaagttgaaccacccttcggtgacagcaaaattgagattggaacaggaacaacaaaactcgttgaagcatggcatcgaaaaggtagctcgataggaaatgcctttacggccacttacaagggcatcacaaaattgacagtgcttggagaacatgcctgggattttaattcactaggtgggtttggagcaagccttgggaaggcggtccatacactgtttggaggtgtattccgggtgatgttcggaggcatgggatggttaaccaagatctttgtgggtgctgtcctagtctggctaggattaggagctcatgacaagacgatcgccaccaccatgatcctggtaggatccatactgatgtacatggcagtgaccgtgggtgccctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaaggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatct

SEQ ID NO: 36 - DNA, 11690 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccggaaagatgaaaagtctaatgggagaattgggctttggatggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggagttgtggtgattgacatgcgtgtgacgtatgacggacaagtgcagatttatcgcgacggagagaatatgacagatcgagttgcgctctttaagctgccaactgacggttgttcagttgggttgccagtttcaaagatgtgccacaaagtggataaaaacatgaaagaaggattagcggacacggattgcggatcaacatgggcagagtttaggttgagataccaacgatgccaagtgaagacacgagcgaagcgagttgcgccagatggcccaaagcaagactttttggcagaagtggaaatagtggcttttaaagccatccgggaaaacaaaagtgtgttgcttgtggtcgtgttgtgcgtggccatcgcgaaaagatggccattgtgggtgttgatactactgtcgattggaacatggacaacggttcgaggagaatacatggaaccgttgtatgtattgaaagcagaccagatgacaatgattcagacaacgttgaggccagaagagggatacgtgacagcgacggcaaatgggttatttgagatgaaaacaggaagagcgttcatctatggaagccaagtggtgaaaacactggtaactgactgtgaagttaacgcgacatattcaactgatatatgcccaggcggatcgcagctgtcaatgcaggacattcaagcggaaggaagagcatgtgcctcggagccgtataatcgaggctggggcactgggtgttttaagtggggagttggattcgtagcaacatgcgcggaggttgattgcaccactagtgtgaaagttagctcagtggctcgctcgacaattaagatgaatgtgacggcaacataccactcagtgaaaagtgtgcagagtgtgataagtgatgtacctgtgacattccaatttgggcagctgggcattgcctctatgacatgtcgtttggagtccgaccgaattgcccaatcatactatcacgtggaaggaaacaagaaggagggactattcatgaaggaacagattgatggatggaacggagccacgttggctgctggaaagatagccaacacagagaaaattgttatttggggagatgtgaaaccaaatgaaattttggttaaggcggtttcagaaccccaactggaatggactaatgctatagctacacatgatggcttccgagatgtgggatttgtttgccagataatgcttgacaagcttgttaccggagtgtttaaagattgtaagacccctaaaacgtccacattcacacaaagcggatttggctttgacggaattataactaccacgttagctgtcgcccaaactgaagcctgctcgatcagcatctcctgtaaaggatgcacgcttttggcaacaaaagcagtgttttccgctggggatattgagtcgaagacatgggtgcgatgcggaaacgagagtggaacagcgatcgttggaggacaagaagttgccgttgcgtgcgccacaaatcccatcacgcagggatggagattggtgaagcatgctactcaacgttaccggaagtttggaatgccaggagtaggtggagtattccacgatttagtgggaacattaaatccatggagtttcttctctaccacgactctggttttcatggcggtagtccttttcatcgtggacaaaagaatcttgattttggggatagcttgttatatgttttattttgtgcgagccgacttcggatgtggatttgacccagataggaaggtagcacagtgtggttctggctcattcgtgtggaagtcactggcccgttggccaatggctgatcacgctattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaaggtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacggctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtacacaatagacctagcaacacccacggacaagaggcttttcatgccgccacaatacggaggaccaatttcgtttgcgaaccacgtgcctggattccaggtgcaagaggactttccctggcagaaggcgaatatattaatgcgccagggaccggttccgggaacgaccgtagtccaggatccacactgtgatgaccggagcgcggcagtgccagttgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagattcaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgattacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgaccatcattatggacgagtgccactttctggacccgatgtccatcgcgtgccgcgggataatggatttccacaacagccgtggaacgaaggtcatcttcatgagtgcgacgcccccaggacgagcaggaaacgctgggtccaactttacaatagaagacagagccatcaagttccccaaggagttgaccgcatcgtggatcaaagacaagtcaataggcaagaccatcgtttttgtgccaacaattacgcaagctgtgaggctggctaaagagttgggaggggtggccttgacccgagatacgttcaatgatgccatggggaaggcccggagtccggaaacaatgtttataatctcaacagacatcagcgagatgggagccaatctcggagtgactactgttatcgacacaagaactgttataaaaccattagtgtctgacaaaggagtttcacttgaaagggttggtgtgaccccagcttcaatcatccagcgcaggggccgagtaggtcggcgggagcccggagtatacatttatccccttgacgtcgaaccagaggagcagccggaaaattgggtgtgttgggtggaggcgcaaatgatcttagatcaattgggctgccatccgatgagagaggagagcgaatttttccgcccacaaggcacgtaccggattgacgacgtagagcagcggaggtttctggggttgatcaaggaaaaactgccaatttggcttgcttggacttgggccagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactatacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcgtgggaacctcgaggagttgtcgttgacctgggatgtggacgaggaggttggtcccagcgcttggtgatggattaccgcgtcgctgaagtaagaggatacacacttggaggcaaagaacgtgagaatccccaaccgttccaaacgaaaggatataacttggcgaatttgaaggctggagttgacgtctataaaatggagccagtgaattgtaacaccataatttgcgacataggtgagagtgacccgcgtcctgaagttgaaaaaactcgaacgctgaaggttttgggaatgctggagaaatggctggaagtcaatccaaacgcctctttttgctgcaaagtgctatcaccttatcacttggacgtgcttcgaaagttagagtcgctgcaacacaagtataacgggcggctggttcgactgtcttacagtcggaactcaacagcagaaatgtattatgtgtcaggaaagagggcaaacgtggtggcaagcgtgtacttcatgcttgggtcgctggtaggtaggctgcggagacatgagccatcaatcatcgaccccccaccggttctagagatgggaaccagaagcgatccgcgagcaaaggccaaagcgcaagacttcgagatgatccgaagaagagtggaacgactacgaggagaaaatcggaaaacatggtttgtggacaacgaacatccatatgtgtcatttaactaccatggatccttcgtgactgatgaggtgacagcgggcggacaaacaacaaatcccttgattagacgcgttatgtggccatgggactttctgtctcgggtgacaacctttatgatgaccgatgtttcaacgtatgcccaacaaaaggtgctgcgtgaaaaagtggacactgtctctgaggagcccgacgagcgaatgaaagcaattaacagactcatcatgacacacttcgtgaaaatgttcaagcggcgcgggctgaaaccgagggtgttgacaccacaagactacatgaataatgtccaagccaacgcagccataggaggatggagcgaagtaatggattggcaaaacgtgcgcgatgctttggcagatcaacgattctgggacatggtagataacgagagggccttacacttgcgtggtgactgtgagctttgcatctataacacgatgggaaagaaagaaaagaagccatctgcctttggcactgcgaaaggttcacgcaccatctggtatatgtggctgggtagccgttatttagagtacgaggctttaggattcttgaacgaagatcattgggttgcacgagaaaactttccatgtggagtcggtggcgtcggcgttaactattttggatattacctgaaggaaatagccgggggaggccggtggcttatcgcagacgatgtcgcgggatgggacacgagaataacccaaggagatctagatgatgagctgttcatgttaaccgagcttgccccaaccacataccacaagaaattgataactgcgacaatgacgttggcttataaaaacatagtggccttattccctagaaatcatccgatgtaccgaagtggaactgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggagcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggcaggatatcatggtctatccaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaagagccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 37 - DNA, 11850 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaagttaacccgtggttttaccctagtttcggtgaatttgccaattttacggaataactgtttgaaaggttcaaactctggtgtccaacgtttgtattaaaatgagtggattaggaggccttcttcccctccgagggaagaaaaagaaagcccctgtgatacaatcacagggcagggtcttgccgaagagcgactggaagggagctccgaaacaggatctaaataaaaagaaagcgaaaaaggacgagacgaaaggccagaattggccaagaagaattaacccccggactggacaatggtcggcaattgagggctctggtgctcggctgtggagaagcattttctctacagacttgatcggaggcttgttgttgttgatcgctattttatcaaatctctacgaaaaggttagacgtgacataacggaattgaaacgcagagtgactcgattggaaaaatctcgagctagtttgattttgaccccaatggtgttgctgtgtctggctatcctcgcggcaggcgtgacaatccaagtggttgtcactactgatgcacgaatcgagctttggtctgaccggaagaactttacagctcacgctcacctcgtcaaggttcctaccgacgtttgcaatgatggggtgtttgtaacaaaacattgtcccaaagttgagaagttgagtgaccttggcgaaatcgattgcggttcatcatggtctgaatttaccttgacttacacacgatgcgtaaccttggaaagagcctcacgtgcggaagagaagggaaagacaatgctggggcagttcaaggaggatctttccaccctggaaactgaggcttttttgctgtttaaaaaacatgcgttctcgaccatcctggttttgctagtattggccatcgttatgaagtggcccgtgtgggttgtggtaatactggggattctagcgtggaacgtcgtgaaaggtgagtttgttgagccattcttggttttaaaacatgaccacagtactatgctcatgaccagactgtacccaggagaaatcgctcacgttgcaactcctgccgggttggtggacattcgtgttagccatgcccaaatttttggaggtcaacgctttcgtgagttactgagcgactgctctgtgaacgcttcgtattcgaccgacatatgccccggaggatcacaacttgacttggaatcgatcaaaggtcctggacgtgtctgcatgaccgctccgtacaatcgaggatggggaaccggatgtttcaaatggggaattggagctgttgccacgtgcgttgagttgaactgcacacgggaaacaaaagttgatttgttgacaaattctgctattgtggccaacgtgacagtcaatttccactcgaccaatgacactaaactccttgtgcctgacaccccaattacgttgaagtttgggaagttaggaacgatgacaatgacgtgtcgtttgggaaatgaccgcattgctaacgatttttaccatgtaactgacaatattgcatctggactgttccagaaagctttgattgatgcgtgggaaggaccctccaagatggcgaaccacattagcggacatgaaaaagtcgtgaagtggggtcacattctcccaaatgagatcaaggtcagcaagatcattgaaatggagttagattgggaaaaagcgatcaccacacatgatggattttcgaacacctatttttggtgtcaagtggccgtgaacaagttggtcgttgggtcatttgcctcatgcaagagcggagcgaaggctagcttcatccaatcctcgtggggttttgatggtgtggttgaagtgactttggatgaggccaccaaaaccatttgctccctacccctgacatgtaccggatgtagcttgttggctacaaaagtggttttccttgagggaagccagcgggctgttgggcacgtggggtgtggaaatggaacatcaatgttgacagtaggaacgacaaaggttgggatccaatgtgtggtcacaccggtgtcacaaatttggaacttcgtgactcacgcttccggacgatatgcgaaacttggttttggaggagttggaggagctttccatgatctgctagtgaaggttggattgaccttcacctgggattcatggaagatcatcaccgtgttgtctggtctcgtagtggcttttgccatctttgatcggaagttggtgatcctgatcattatcctctgtggaatcgcttatacccgagctgacattggatgtggcattgattttgacaggaagacctacacgtgtggaagcggtctattcgtgtggaagggtttgggaaaatacccaacggccgaccattctgttgagtttgcctcatatgattttctatcagcgtacctccaggagcagtttaagtctgagaagaaggtttgtattatttgtgaagacattgtccagtgtgaggcagctagaaaagcagccgctgcggtgtataaaaacctaggccacccgtttgtctacgtgaacacgtcggactcctatggaaaagtatttgccgaaatcccgaaaagagtccacactgttagtgtgggagtcgacgttgtggaaatggccatgatgactagggagaacaaaccggttggaccgtttggtgacttaccgcgtagtatggtttcgtggaagagtatccctgaaacagaagagcacccagtgttgagagtgttgacatcttcaagtgattaccagaaggtatgtggaaaagcgattggattccagtatgattttgttggataccgtcggaccatgtatggatctaatgtccagttaaaaatatcaaagaaggtttcgattgaatgtcccacatacttggcaggagtcgccgtgaaaaatgatagaacggttttcactgatggaatgttctggatgtcatcgaaacgtgagaatggaacatacgcgatcactgagttagagatggagcagtctcacaagtgcatctggccagaccaatacactcctgacgccactttgacgccacgtgacaatgaaatgtttgttccgcctgagtggggagggccaatgtcgaaagccaaccacattcctggttacaaaatgcagactggatttccatggaacaaagcccccattcggtttgttgagggaagtgttccaggaaccattgtcacacagattagtcactgtgatggtagagggattgcagccgaagtgaatccagcaacgcagcccaattggtgctgtaagtcctgtacaaggattttccactttgaagtcgatgggaaactctattatccaatggagattcggcccgacccgaaaggaggggaacagcaaaaagttcctgtagtggagacacccattggagatgaagaaaccgagactgttggtggatggctgggtagaatgtataacattccaggagctgagggatcatatgcggattttcgactccccaagttgccaaattcaagaccaagcgcaatggtggggagtttggtcaatctattatgcttgatgttttcaattcagatagttaccaagactatgcgggcaagaacgcttatgcgtttctatctttgttgcttggtttttatgttctttggaatgccaactttgtttggattaagtgggtttttggcgtggatgatgattctaccaatctcacacaactcggtaacaatgtgcaacctaaccgtgcatctgtgggctgtactgctaaaccagagctcggcgatgtttctgtggggcctaacgctccgatcccagatacagaggtctaccgctggacagatgctactctttaccatgcagatgttgcatcacgccatctacgcgcactcttgggtgttcgggtgggtcatcgaagtatgcttgtcagtcgggcttatgatgaacttgttaaccgtcatcgatacggttcacccgaaactgatcgcatacttgctcttcttcggatggaaaacgggcatgtgcgtagtgtgcgcttggttattgatatactcaatcaggagatggaactctatagtcgccgcggctccggccgcgggcgggtggaggtcagggtatcgaacaatgatgtcctccagtttgattgttatctttatcagtgtaggaattgcaggagttatcgcttcggactatggaggttatccggctgcggctgcggtgactgcagcattgttgataatgggaatcaaaatgtttgactttctgacgacccgattgtctcttgagttcgtatctgcaggcatgttccccgaaggtgttgaaaaagcctttgaaccggactcggtcagtgacttgtttagggcatctttcactgtagatgggataaagttgcaggaccatgttgaaccgatccccattttgtttgccattttgtacatctttattggagctgtggcctgtaaggttaacccggccctcggaatagtgtatgctatcgccatgttcgcgactcctttaccggagttaatgcgtttatacatgatgaccatctattcctctacatttcggacagacactctgcttgggatggctatcccagaaacggagccagaactgtctcaagactttgggccaatccctgatgggatttatcgggtgaacaatcatggattttcagtgaagagtcatcggggagttggaatcgtaaagaatggggtttttcacactctcatgcatgtcacgctcaatgagccactcgcgtggcaaaatcgcctagtaggaccttcaatgggccactctctcaaggactatgtcacatacggtggaaactggcaattgcctgactttgatattgttaatgaggtgggcataatggtttgtggacgggatcgttccattcagtacaaaagacacgaggttgggacaatcatgatcgacgacaagcgagtgatgtacttcactcatgattacgggcacggatcatctggttcaccaatttttgtgaacggagaacctgtggccttatacggcttcgggttccatttgtacaataggtatcgatcaatagttctgcctatcccacgtgaagaagtccttgatggggctagtaatgagggcataccagctgagcacggaaccatgcgcaacaagttttttgttgactggcatccaggaaaagggaaaacccgaaaagtgatcgttaaagaggtgttaaatgctttgaatttagcacggcggattgttgttctggcccctacacgagttgtcctggctgaaataactaaggcaataggggaaaacacatcaaaaacgccctcaaaaaatcttgctttcaccggtcacaatattgtgacggtggcttgccacgcgacgttcactgattatgttttgcgtcatgggttatcaaaattcaaagctcacgaagtcataatggatgagtgccattttctggacccacgatctatagctgcgagaggaatcctggagcatctggcaactaaacgtggagttaaagtcacgtttatgagtgcaacgatcccaggacgtgaaccttcactcgggtcgaattttgagatctctgaacaggccttgcagtttccccgtgacgtcaaccaaaggtggatagaaactgttgctaggggaaagaccgttgccttcgtgccatctcacagggtaggtgacaagctagctcgcgggtgtccccaagccatttccctgcataggaacaattttgacaccaattacagcacagctatggatgagtccataaaatttatctacaccactgacatatcggaaatgggagccaatttcagtgctgacaccgtcatagatttccgggtggcgattaagccaaagatttctagtgaatttgccgtcactcttgaaccaactccgatcacgcgatcatcgatgattcaacggcgtggtcgagttggaagacaacgacctggaacctatatttacccagttgacaaaggcgtcgaagatgcctccgatcagttggcttgttggacagaagctcagatgttgttggatcaattggacttgacaatgatggcagaggaagttcggcagtcaaacattccaggggcttacaaattagttgggcgtagcctagacatatttcggaagttgctggagaaggatgacataccaatctggctgagctggaagtgggccgacagtgttcaacaacaatactccatattgtttgaaggagaacgtcaagagaatgtcgctcgtgtcgtcaacactcgagactatgcttctctagagtataagccgaagtttgttgatgcacgattcgagcgtcttggatgggatcaacgaaagctgtcaattcagttttacatgaacactcggagcttcataactttcgccactttgtcacacgtcatttctcaagtgatcgaagctggagttgtcaattctgcttggaagcgaataggagacgttagcatcatctttactgaaggaggcgacccacatgctaaagatgaaactatcatggcttggactattctggttggaggagtgttgggggctcttggattcctcatagttgcatggggaatgaaggctgtcttgcgagtaattttcggatcccgcgataagcatcttagcgtcccaaccttagtggcggatttccaaccatacatagtgtgtatagttcccattgccctacatcttgctggggttcctataccaatgacaattgtgtttttcgcgatgcttttcttgacttatccactaatgtacaagagtgccggacaacggagttatgttgacattgacttggtgaaatggattctgttaggtggatgtattgtaactggagtcatttgctgggaaatgagattgctcccaaacatctcatcagacatttcagctattttgaataggcaaagacaaagggaagacaccccaacttttgatgcttcaccaccttgggaatggttggatttagcacagccagtccctcacaatgttgaattgacgtcagtggtgataactacattcacgacctgtctgttcttgcaccaaattgtcggatggtcatacgagtcagagtggctgaaatcctatttcgaccacaaaggagtgggtcagatcatgggtggttttcggttggacacaatttcatggggatcagctctaagcggtcttctgggcacagctacttatgcctcatggggagccattttgactgggttaggaggagcggttgtgtattttttcctgatggtttcaatgctcaagtggaacttttcgggaggagccacaactggcttagaaaacaatgtcatgcgaaacgaccgagaaactggactaggtaatcggccggcaaacgacaataggcgttccctcctgtacggtgtggtggcggctgaatgtcttgtgtggttgttctgtttcagaactgccacggatgccatagtggtggcttgtttagtgtcctattgtttatggatcatcaacaacccggctagccctcaccacaaaaacactgacttaggatcggcgtgtagtttcatcggtcttttgtactgtacatgtcctactcaaaaatgcatccaagtattgatgaggtttgctttggccaggttgaacatgaacacccgctctctggaaaaaagcgcgacgggaggccttggacaccgttggaagaagctattaaatgcgatgacactattggaattcaacgcttaccgatcttgtggagttgacgagactgagaagggtgactatgtgtcacgaggagggctgaagctgagagagataaccatgaagtatggttggaagccagaagggatatgtgttgatcttggatgcggcagaggaggatggtcacagcacttggctatggatccccgcgtaactagagtggaatcattcacgttaggaggaacagcacgagaaaatccccagccaatcaagacacttggtcataaccttatccggttcaagagtggagtcaatgtgtataatatgacgccaacacatgctaacaccatagtgtgtgatatcggagaaagtgaccccaaaccagaggtggaaacctctagaacattgcgggtcctcaaaacacttgaactatggttggccaggaatccaaacgctgaatttgtgtgcaaagtcctttgcccataccccgtggaagtcctcaaatgtctggaaacccttcaacataagtatggcggaagaattattaggtcgacgtatagccgaaattcaagtgctgaaatgtattacatttctggaggccgtaacaacatggtgaaggttatcttcaccaccctccactccttgatttcgaggatacgaactaggccggagaaaatcgtcaaagaaagtgtttctctaccagttgggactagaagcgatccagggcacaagatcaagagtatggatccaaagatgatagcaacgcgggtggaaaagataaaaaaggaacatgcggacacgtggttcgttgacaacaaccatccataccaatcatttcggtatgtgggatcgtacgtcacagatgatgtgacaccaggaggtcagactgtcaacccattaatgagaaaaatgatgtggccgtgggagactgttggaggagttgtaaatttcatgatgacggacgtgtccacatatgcccaacagaaggtgttgcgagagaaggtcgacacactatcccctgaacctccaaacgacattcaaagggttaacagatggatcaccgagttcttgtgtgcttcattcatgcgtcgagggttgaaacctagaatcctgaccatggagcaatatatcaacaacgtaaagagctcagctgccattggatcgtggagcagtgatgtcccgtggagcagtgtccgagaagctttagctgataaaagattccaccaaatggtcgaggaggaaaggaaactccacttagcaggagactgccgcatgtgcgtgtacaacaccatgggcaagaaggagaagaaaccttcagccatgggcgtggccaagggctctcgaaccatttggtacatgtggttaggttcacggtttttggagtacgaagcccttggcttcttaaatgaagatcattgggtgtcacgagacaacttggcatgtggtgttggtggagtgggagtgaattacttcggctactacctacaagaaattgcacggaaagggaagttttttatcgccgatgacatagcgggatgggacacgcggatcaatgagagtgacttggccgatgaggaatttctcatcatgtccctcatttgtgacccataccatcgatcacttgcaaaagccgtgtttcggtttgcctaccagaacattgtggccttgtttccgcgaaatcatcctgggtttggaagtggaacggtgatggatgtcgtggccagaactgaccaacgaggttcaggacaggtcgtgacttacgctctaaacacgataacgaacgccaagattcaattaggcagaatgctggaagccgaaggattactagacgctcatgaacatgtaatcaaaaaatggttaaacgacaatggtgaagaggctctctccgggatggtggtggccggggatgatgttgtagttgcgaccaacaacggaaatttttcaaggtccttacgatacctccatttgaacgggaaaattcgtaaagacattgatccgtccctaccgtccaaagttgaaacgaactgggaggtggttgaattttgttctcaccattaccacgtgatgaccttaaaggacggacgacgaataattgtcccatgccgagagcagaatgaaatcattggacgaggcaggattcaaaaaggagggttggtgacccttgccgaaagtgcctgcctagcgaaggcttatgggcaaatgtgggctttgtatttctttcaccgaagagatctgcggatggcttttctagccataacttcgagtgttccaatagactggttcccagagggccggacctcgtggtcgattcaccaaaataaagagtggatgaccactgaggacatgttgcgggtctggaatacagtgtggatccaggacaatccctggatggaggacaaaatggaaatcgaaaattggagggacattccgtacctcccgaaatccatggacctaaagtgcggcagtctcattggaacaaaagaaagagccgcttggtcaaaggatctgccgtcaacggtcacggcagttcggaaaattatcgaccaagacacgaaaaccgagaatgtctaccaagactttcttggcggaatgggccggttccaaacgtacactgaccccatggcaacgtaagaaaccatcttttccaaattagtcgaaaaattttgcccctcttcgaggggctttggcggcagcaggagattttctccggggtttcacgctccccccgatgccagtggtcacagcccaagtcagagacttggagttgtggcgggacagtgagctctgtcagtggtcaatagctcaataaatatggcagcagagcttgtctcggggattcacgctccccccattgtgagtgtgtcgaactggtttcgaaggacgtctagaacgacgctaaagttcaaatccggcaacagagagtttatgtctcggggcctcacgcaccccccgttgtgagtgaagtcctttctggccatttagtggtcaggaagggtaccgttttggaacgacggaaataagttccatggagcgacactagccccactgaggggcggttggaatgacacccaacccgctatagtgcgtcgacaggtcaattagctacctggaataagctaatgtgcagggcaacaaagttctaacgaactagggtgagtagcgtcaccccccggttgtgaaaacgattgcgactagaactaaagtcgagagtctccccaccgataggggagctcgtcagtttgttttagtccaattacgct

SEQ ID NO: 38 - DNA, 11980 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcagtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 39 - DNA, 10732 bp, Palm Creek virus
agttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccggaaagatgaaaagtctaatgggagaattgggctttggatggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggagttgtggtgattgacatgcgtgtgacgtatgacggacaagtgcagatttatcgcgacggagagaatatgacagatcgagttgcgctctttaagctgccaactgacggttgttcagttgggttgccagtttcaaagatgtgccacaaagtggataaaaacatgaaagaaggattagcggacacggattgcggatcaacatgggcagagtttaggttgagataccaacgatgccaagtgaagacacgagcgaagcgagttgcgccagatggcccaaagcaagactttttggcagaagtggaaatagtggcttttaaagccatccgggaaaacaaaagtgtgttgcttgtggtcgtgttgtgcgtggccatcgcgaaaagatggccattgtgggtgttgatactactgtcgattggaacatggacaacggttcgaggagaatacatggaaccgttgtatgtattgaaagcagaccagatgacaatgattcagacaacgttgaggccagaagagggatacgtgacagcgacggcaaatgggttatttgagatgaaaacaggaagagcgttcatctatggaagccaagtggtgaaaacactggtaactgactgtgaagttaacgcgacatattcaactgatatatgcccaggcggatcgcagctgtcaatgcaggacattcaagcggaaggaagagcatgtgcctcggagccgtataatcgaggctggggcactgggtgttttaagtggggagttggattcgtagcaacatgcgcggaggttgattgcaccactagtgtgaaagttagctcagtggctcgctcgacaattaagatgaatgtgacggcaacataccactcagtgaaaagtgtgcagagtgtgataagtgatgtacctgtgacattccaatttgggcagctgggcattgcctctatgacatgtcgtttggagtccgaccgaattgcccaatcatactatcacgtggaaggaaacaagaaggagggactattcatgaaggaacagattgatggatggaacggagccacgttggctgctggaaagatagccaacacagagaaaattgttatttggggagatgtgaaaccaaatgaaattttggttaaggcggtttcagaaccccaactggaatggactaatgctatagctacacatgatggcttccgagatgtgggatttgtttgccagataatgcttgacaagcttgttaccggagtgtttaaagattgtaagacccctaaaacgtccacattcacacaaagcggatttggctttgacggaattataactaccacgttagctgtcgcccaaactgaagcctgctcgatcagcatctcctgtaaaggatgcacgcttttggcaacaaaagcagtgttttccgctggggatattgagtcgaagacatgggtgcgatgcggaaacgagagtggaacagcgatcgttggaggacaagaagttgccgttgcgtgcgccacaaatcccatcacgcagggatggagattggtgaagcatgctactcaacgttaccggaagtttggaatgccaggagtaggtggagtattccacgatttagtgggaacattaaatccatggagtttcttctctaccacgactctggttttcatggcggtagtccttttcatcgtggacaaaagaatcttgattttggggatagcttgttatatgttttattttgtgcgagccgacttcggatgtggatttgacccagataggaaggtagcacagtgtggttctggctcattcgtgtggaagtcactggcccgttggccaatggctgatcacgctattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaaggtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacggctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtacacaatagacctagcaacacccacggacaagaggcttttcatgccgccacaatacggaggaccaatttcgtttgcgaaccacgtgcctggattccaggtgcaagaggactttccctggcagaaggcgaatatattaatgcgccagggaccggttccgggaacgaccgtagtccaggatccacactgtgatgaccggagcgcggcagtgccagttgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagattcaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgattacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgaccatcattatggacgagtgccactttctggacccgatgtccatcgcgtgccgcgggataatggatttccacaacagccgtggaacgaaggtcatcttcatgagtgcgacgcccccaggacgagcaggaaacgctgggtccaactttacaatagaagacagagccatcaagttccccaaggagttgaccgcatcgtggatcaaagacaagtcaataggcaagaccatcgtttttgtgccaacaattacgcaagctgtgaggctggctaaagagttgggaggggtggccttgacccgagatacgttcaatgatgccatggggaaggcccggagtccggaaacaatgtttataatctcaacagacatcagcgagatgggagccaatctcggagtgactactgttatcgacacaagaactgttataaaaccattagtgtctgacaaaggagtttcacttgaaagggttggtgtgaccccagcttcaatcatccagcgcaggggccgagtaggtcggcgggagcccggagtatacatttatccccttgacgtcgaaccagaggagcagccggaaaattgggtgtgttgggtggaggcgcaaatgatcttagatcaattgggctgccatccgatgagagaggagagcgaatttttccgcccacaaggcacgtaccggattgacgacgtagagcagcggaggtttctggggttgatcaaggaaaaactgccaatttggcttgcttggacttgggccagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactatacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcgtgggaacctcgaggagttgtcgttgacctgggatgtggacgaggaggttggtcccagcgcttggtgatggattaccgcgtcgctgaagtaagaggatacacacttggaggcaaagaacgtgagaatccccaaccgttccaaacgaaaggatataacttggcgaatttgaaggctggagttgacgtctataaaatggagccagtgaattgtaacaccataatttgcgacataggtgagagtgacccgcgtcctgaagttgaaaaaactcgaacgctgaaggttttgggaatgctggagaaatggctggaagtcaatccaaacgcctctttttgctgcaaagtgctatcaccttatcacttggacgtgcttcgaaagttagagtcgctgcaacacaagtataacgggcggctggttcgactgtcttacagtcggaactcaacagcagaaatgtattatgtgtcaggaaagagggcaaacgtggtggcaagcgtgtacttcatgcttgggtcgctggtaggtaggctgcggagacatgagccatcaatcatcgaccccccaccggttctagagatgggaaccagaagcgatccgcgagcaaaggccaaagcgcaagacttcgagatgatccgaagaagagtggaacgactacgaggagaaaatcggaaaacatggtttgtggacaacgaacatccatatgtgtcatttaactaccatggatccttcgtgactgatgaggtgacagcgggcggacaaacaacaaatcccttgattagacgcgttatgtggccatgggactttctgtctcgggtgacaacctttatgatgaccgatgtttcaacgtatgcccaacaaaaggtgctgcgtgaaaaagtggacactgtctctgaggagcccgacgagcgaatgaaagcaattaacagactcatcatgacacacttcgtgaaaatgttcaagcggcgcgggctgaaaccgagggtgttgacaccacaagactacatgaataatgtccaagccaacgcagccataggaggatggagcgaagtaatggattggcaaaacgtgcgcgatgctttggcagatcaacgattctgggacatggtagataacgagagggccttacacttgcgtggtgactgtgagctttgcatctataacacgatgggaaagaaagaaaagaagccatctgcctttggcactgcgaaaggttcacgcaccatctggtatatgtggctgggtagccgttatttagagtacgaggctttaggattcttgaacgaagatcattgggttgcacgagaaaactttccatgtggagtcggtggcgtcggcgttaactattttggatattacctgaaggaaatagccgggggaggccggtggcttatcgcagacgatgtcgcgggatgggacacgagaataacccaaggagatctagatgatgagctgttcatgttaaccgagcttgccccaaccacataccacaagaaattgataactgcgacaatgacgttggcttataaaaacatagtggccttattccctagaaatcatccgatgtaccgaagtggaactgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggagcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggcaggatatcatggtctatccaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaagagccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 40 - DNA, 10848 bp, Binjari virus
agtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctgccactttacgcaccgttggagacttgacatggctaaatgtgtcaaccactgatgttggaaagtggatacgtgtggagaataggcacggcaaaggagagtgtttcgtcacggccactgacgttggaacatggtgctcagactctgtgggatatgaatgtcctcaaattgcaccggcgtatgaccctgaagacttggattgctactgccgaaacacctcaacctacgttacttatggaaggtgtaaaaatgggcgcagtggacgatctcgcagcaagagagcaatcacgatagccccgcacggcgaagcaggattgcgtgttggaagcaccaagcattggacttctagagcaactccacaacggtatctaatgcgcgttgagaaatgggtgctgcggcatcctctacctgctctcgtgttggtggtactgggatggatgatgggtcgttctcacggccagagggccatgtatatagtgctgatgctgcttgtggctccgtcatatggtaaccaatgcctggatgtgcagtcacgtgatttcgtgcaaggggttagtggtggcacctgggtagatgttgttttggatcatgacaattgcataaccattgttgctgacgggaaaccatcttttgatattcgtttgtcgaaaatgagcatgtctaaattcgcagagtacaaacggtattgcctccaggccacgatgagtgatgtcactagcatagtggcgtgtccaggggctggggatgctcataatgacaagagcaaaaaccacgagtacatttgcaaagctgttaacaatgaccgcggatggggcaatgggtgtgtcctttttggcaaaggatcaatggaaacttgtggtaagtttgaatgtaagaagaaaatggctggcaagttagtggcacgtgagaacgtggaatcagtggtcactgtgcatgtacatggtgcctccgcaactgacacaaaaggagttgacaccgcctctacagccaaagcgactatcacgccaaaagcttctgtggctactctaaatttaaacgactttggtagcctggaggtggattgttcaactgatgttggcatggactttggagagattgtggtggccgacatgtcaggaaagtggtggatcgtgaacaaggattggttcaatgaacttgctttgccgtggtccacggctagcaccactgctgaagtttggcaggcacgagacagacttgttgagtttggatggccacatgcggccaagcagaacatctatgacattggggaccaagaaggagctgtgacggctgccatagcccaggcacccatggcgaaatgggagtctgacaaggtcgagctaatctctgggattctcaagtgcaaggtgaaacttggcaacctaaagctgcgtggggtgacctatagcatgtgtgcccagacattcaccacggaaacaaggccggccgacaccggacatggcactgtggctttcaaggtgaaatacgtcggaacagacgtgccttgccgggtcccactccacatcatagacagtgacggcggagtggccgctggacgagtgataacggcacaccccttcgtcatgaagcagaatgattacattattctggaagttgaaccacccttcggtgacagcaaaattgagattggaacaggaacaacaaaactcgttgaagcatggcatcgaaaaggtagctcgataggaaatgcctttacggccacttacaagggcatcacaaaattgacagtgcttggagaacatgcctgggattttaattcactaggtgggtttggagcaagccttgggaaggcggtccatacactgtttggaggtgtattccgggtgatgttcggaggcatgggatggttaaccaagatctttgtgggtgctgtcctagtctggctaggattaggagctcatgacaagacgatcgccaccaccatgatcctggtaggatccatactgatgtacatggcagtgaccgtgggtgccctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaaggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatct

SEQ ID NO: 41 - DNA, 10839 bp, Bamaga virus
cgtaaaatccgtacgcttgttttggcacactagtttgtgacataaggcttttgtcgcgcgtattgggtttaactttttttcgagaaatcgagaggtaagaagaattgaaagacattatgtctaacccttccgtcaggaggggtgtcaatgtgatggcggctcagaaaaaacgagtcgcccaaaaaataaaatcaatgaggaagggaacccagagcatcagcaatggagttaggggtttcatcctctttttcatatcccaaatcttctgggcacgtaagatcacgcccagagtgaaaggattgtggaaaaaactagacaaatttcaggcaatgaaggttttgaaagggctaaggaacatcatcaatggattgatgagatcggtcgctgggaaaaagaaacgccgtggagggaataccgtgccattcttagtgatgatgatggtagcaacaacatgggccttaactctcaggaagattgacaacactattgttctgaatgtcacccaaaatgacatagggaaaacatttcctgtaaggggcggtaattgttccattaacatcaatgatgctggatactggtgtcacaatacagtcgaatatgattgtgtcaccatagctggtacggaagagcctgacgacattgattgctggtgtgttggcattgaaggagtgagagtgacttacgggaaatgttcaaagtcatcaccgcacgggaggagatctcgtagagcagcagtcattcccgcgcatggtgggcagggactatcaacccataaagagacatggctatccactgtagcaggggaaaggcaaatccaacgtatagaaagatggatcattcgcaatcctctttatgccgctgcaatggtgactgtggcgtattttctgggaagtgacaccaaacagaaagtgctgttagctgtgttaatgttggcaattggacctgcttacggctctcactgcattggaattgaacggcgtgactttgttcatggagttcagggaagcacatgggtaaatctagtgctggaccagggatcttgcgtgaccatggtgactgaaaacaagccaagtgtggatgtgtggctcaaggaaatctctttgagtcaacccaccttggttaggagatatagccacacagcaaaggtccataaaacagaaatcaaagctgcttgtcccacaatgggagaggccaaacttgatactgaacacaatccgtcgtatgaatgcaagcgcacttattcggatagaggttggggaaacggttgtggtctgttcggaaagggtagcatcattgcatgcgccgagttttcctcaacgggccatatggatgtttatgaaattgacatgaccaagattgagtacatcgtgaactcgcagattcatggaactgtgctcgttgagaacaattcccagcatgcagtagagtcaaagttccagccaacaacaggaggagctgaagtcacacatgcagggtatggcacacttggcttggactgtcatgtacaaaccatgatggatctgaacaacttctatctggctgtcatgggatccgatgcatggctagtgcacaagcaatgggtggaagatttgacattaccctggatggcaggtgaaactggacactggaaagaaaagaaatatctagttgaatttggtgaaccacatgccacgaagatggaagcccttgttttaggttcccaggagggggctttgaggactgcccttgctggagctatggtcgtggtgtactcccaaaatgacaaaaaattcactctgaaggggggtcatgtgagttgtagagcaagattgactgacctgacattgaaaggaacatcatatccaatgtgcaagggctccctcaagttcacaaagactccagttgacaccggacatggaacagcagtgatgcatgtgcaagtgacgaaaggggcaccatgcagaataggagtccaaatggctgacaactcaaatggaggaaagtcgttgggaagcatgattacatcaaacccaatagtctccactgatggtgaggagactctggttgaagtttctcccccatatggagaaagttacatcatagtgggatcaggcgatggcaagttggtttaccattggcacaagactggaagcactattgggagcctgttctcagaaaccatgaaaggagctaagagattggcaatcctaggtgatgacgcatgggacttctcctcaacgggaggggtcttagcctcagttgggaaaatgctgcatactgtgtttggacaagctttccatgcaatctttggagggttgagttggatttcaaaaataattctaggttgtgttatgttgtggataggtgtgaactcccgcaatggcacattgagtgtcaccttgttgactgttggcggcattctgttgttcatgacacttggagttaacgctgagtacggttgctcattggacttccaaaggaaagaactgaagtgcggcgatggagttttcgtgttcaatgatgccaatgattggttgaccaagtacagatatcatcctgaagacccacgaacattggcttctctggtcaaggcttcatataaggccggacggtgtgggcttggatcagttgacaacatggaacataagatgtgggtgtccctggaaaatgagttgaatgccatctttgaggaaaaccaagaaaatatctcagtggtagtgaaggagagtaatggaatataccccaaaggaaattatccattcactggcactccagaaaagctgaaatatggatggaaaacatgggggaagaaattggtatttgccccggttttgagtaacaacacctttgtaatagatggaactcccgatgattgtccttacagcaacagagtttggaattcatttgagattgatgagttcggagcaggtttgactcataccagggtgtttttgaaacaaagactggaaagaaaagaagagtgtgacaatgcacttttaggagctgcagccaaaggggacgtggcagtccatggggatcccaacttctggatggcctcaaacaaaactggagaagtgtggcagatcaatgaattaatgtcactaaacctcaagcactgcacatggcccttgtctcatacgttgcatggcaatggagttctggaatcagacatgttcgttccgaaaagcattggaggaccggttagtcaccacaacttcattaaaggctacaaatctcaggtaaatggaccttgggcatcagtgcctctagaaatgcatcggagagagtgccctgacacagtggttcaaatagatcagaactgcagcgggagaggcaagtccacacggagcactacaaaggaagggaaaataatccgggattggtgttgtcgaaactgcacgctgccccctgttagctttgatggtcctgatggatgctggtatgctatggagattagaccgcagaagatgaatgaaaaacatttggtcacttcatgggtaagtgccggtgacgggatggaaaatggtaacattggattggtggctctctttgtgtgctttgacatgttcttgaagaacaagaacacccgaaagattagcttggttggagccttgtgtctattgggcgcaatgatccttgggaatgttggatttgttgatctaataaaattcatgattgtggttggtgaacatttccgctccttcaaccatggaggtgacgtctcctacttggtcctgaccgctgtctttgacatcaggccagccctgctctgcggctttgtgctgcgcaagaaatggagtcctagtgagagagtagtcatggccattggaatgatgctcctgcaaacggtgtgtggggattggactcagacatcttggtgggaatggctggatgctgttggattggggctcttgatcctcaatgcagtagctttacaaagatggaaaccggccattttggtcttgctgacaatgttgactccgctgaatatgcgagtaattcaaggtgctgcagggggagtgtgtggcgttatggtggccatgtctttgtggaaaacagaaggaagaagtctccgtaagagttacctgccagtcattggctatgttgcttcggcttttggatgggggtattcatggatcatggcagtgtacatcatgtgggcaacccatgtgtcaaggagatcttggcctgtaggagagctggcagcagcaattggacttttgggagctgcaatgggaatggcatccacaaaggatggagccatggtcatgccaatagctgtgctcggattaatcatggtgatcataggaatgacaggcaaatgcgatggaatggagattcgcaaagttgggtgtgtctcgtgggaagactccgctgagatcagtggttcaagctccaggtatgacgtggctcttagtgatggcggagaattccagctgttagagaattcgcggcccccctggaatcacatcattttcctcaccctgggaatgctggcgtcagcagtgcatccaatagtactgggtgtggtcatacttgcctgggggtggtttgcaggcaaaagccagcgcagtggagttttgtgggacgtgcctgttgctccaaaagttgaggaccatggaccccttgaggatggaatttacaccattttccagaatggattgtttgggagctcccaggctggagtaggagtggctcagggaggcgtgtttcacactatgtggcacgttactcgtggaggaatcctgctgcacaaaggtaaaagactcacccctggttgggctagtgtgaaaagtgacctcatttcgtatggaggtaaatggagacttgatggaagttgggatggagtcgaggaagttcagttgattgctgtccctcccaggaaaaatcctatcaatgttcaaactaagcccagcattttcaaattaaagagtggagaggagatgggagccatagctttggattaccctagtggaacttcaggatcacccattgtcaacagagctggagtcgttgtggggttgtatggaaatggaattgtgctcaatcagggtggttatgtgtcagctattagccaagcagctgtggaagaggtcagtagagatgagctacccggaattgaaggctacctgagaaaggggcaactcaccgttctggattttcacccaggggcaggaaagacacgtaacttcctgccccaaatcttgaaggcatgcaggacccgcaagttgcgaacactagtgctggccccaaccagagtggttctgagcgaaatgaaggaagctctgaatgatcacgatgtcaagtaccacacacaagctttctcatctgccagttcaggacgtgaactgattgacgctatgtgccatgcaacattggcatatagactattggaaagcactagggtgataaactgggaggttgtgataatggatgaggctcactacatggatccagccagcattgctgtgaggggttgggctgcccatagagctagagctcatgaatgtgcaacaatattcatgtcagcgactcccccagggactgcaaatgaatttcctgaatcaaatggaggcattgaggacatccgcaaggacatccccagtgaggcttggaacaaaggtcatgagtggatcctagaggatagaaggccaacggtgtggttcctgccctctataaggagcgcaaataacattgctgcatgtttgaggaaagccaacagaacggttgttgtgttaaacagacagacctttgaaagtgtgtaccccactatcaagacaaagaaaccggacttcatcctagccacagacattgctgagatgggggcaaatcttcatgtggaaagggtaattgactgccgaactgctttcaagccagtgctcagtgaggatcaggaacgggtaacactgaaagggccaatgagaatatcagcttctgcggcagctcagcgaagaggccgtgtggggagagatccatccagagagtctgacacatattactatggagaggacacctcagaggacaatgaccatttggtgtgctggactgaggcgtctatgattctggataacatggaaattaaagggggaatggtggctccgctgtacagcgtggaagccacaaagaccaaaatgacgccaggtgagtgtaggctaagagatgatcaaaggaaaacttttagagcattaataaagaaacatgagctgcctgtgtgggtctcatggaaggtggccaaagcaggaatcactccagatgataggaagtggtgttttgatggagaggaggacaacaccgtgcttaatgacatgggggagaaggtcatgggaagaagcccaggaggtgcaaagaaagctttgtgccctaggtggtcagacgcaaggctgactagtgacaatgcttccctcatgaacttcctggcatttgccgaggggaggagatcatacatgaggatcgttgacgctctcatcatggtgccccctatgctgaaagaaaaggtggtggatgcagcggacaccttagcactactactgcgttccgaggagggcagcagggcctacaaacttgctcaggagagcgctccagaagcgatcacaacactcatcatggtaaccttcctggttctgctatcagcaggactggttctgatgctcatgtggccaaaagggattagcaagatgtcattgggcatgctcaccatgagcgttgcgggataccttcttttggaaggagggctcacccaagtgcaggttgcaggaatattgctggtgtttttcatcttgatggtggttctaatccctgatgatggctcccagaggtcaatcaacgacaacaagctggcttacatgatgacaggaattatccttcttgttggagctgttgctgctaatgagatgggatggcttgaaaaaacgaaacaggatttgtttgggaaaagggaagaaatgccgggatggaactgggatttgggacttgacctaagacctggagcagcctggaccacttatgtggctctggcgactgtccttggcccagtgatagaccattggatacaagtggaatatggaagcgctagtttgactggcatagccaattcagcaggcatttccgcatttctggacaagggggttcctttcatgaaggtcaacatggcagtggtggttctgtttgtgagcgcatggaatagctattccatgctggccatcatggagggttgcctgatggcaggcattcatttttgcctgttaatccctgggctgaaggcaagagcaatgaagaaggcccaaaagaggatctatcatggtctatctaagaatccagtagttgatggcacacccactgtggatattgaagaagctgaagaaactccagtactgtatgagaagaaagtggctttggcactgctgggagttgtggctgcgctcaatggaattgtggtcagaacacctttctccatggctgaatcaattgtgctggggagtgccttggtgggtccttttattgagggtaacacgtctccactttggaacgcccctatcgcggttgcgttcgctggtctaatgcggggacattatagcagcatgataggattggcctacaatttttggatattgcaaaaccccaaaagaggaggtggtgagaccatgacccttggccaggtgtggaaaaagagactgaacatgcttgacaagaaggagtttgcaaaatacaagatttcagacattcatgaggtggaccgtaggcaagcacgtaccattctggacgcaggcatcaccaacgttggagtcagcgtgtcaagaggaacatccaagctgaagtggctgacagacagagggtactttaagccagaaggtagggttgtggatctcgggtgtggccgtggaggttggtcatacttggctgctgcagcaagagaaaccctggaagtgaaagcttacactctaggtgtgtcagggcatgagcgaccaattcaaatccaaagcctgggatggaatgttatcaagtttaaggacagagttgatgtgcacagacttccaatcgcccaatgtgacacagtgatgtgcgacattggagagtcttccagctcttgggaacaggagcgagagagaaccctgagggtaattgacctgatggagaactgggtggccaagagcagacccaaatactgcttcaaggttttggctccctactcctcagaagtgattgagcgtctggaactgtttcaaagaagatttggtggcgggataatcagggttccactctcacgcaactcaacccatgagatgtactacactagtgaggtcaccaataacattgtgcacatggtgaactgcgtctcaagattgctgctccggagaatgaccaaccccagtggaatagccatcttagagccagatgtggtttttccaacaggaacacgcaatgtcaagggggacttgggccccttggacatggagaagatcaagatgcgtgtatccaagttaaaaaaggagaacttggacacatggtggcatgatgaaaatcatccatacaggacctggcattaccttggaagctacgttgctaaacagagtggcagcgcagccactatggtcaatggaatagtcaagctactgagcatgccatgggataggattgaggatgttactgccttggccatgacagacacaacaccatatggacagcaacgtgtgtttaaggaaaaggttgacactagggctccaccccctcctccagggactaggaaaatcatgagcattaccaacacatggctctttgatttccttggccgaagcaaacaacctagactgtgcaccaaagcagagtttatagcaaaagtcagatcacacgctgccataggcaacatgttggaggagcaggaaggctggaaaaatgcagctgaggcagtgaatgatccaagattttgggaattggttagtgaagagagggagctacacttacaaggaaaatgctccacatgcatctacaacatgatgggaaaaagagagaagaaacccgctgaattcggacgtgccaagggaagcagagccatatggtacatgtggctcggagctaggttccttgaatttgaggccctgggtttcctcaatgaagatcattggttctccagagacaactccaagggtggtgttgaggggatgggcttgcagtacctaggctatgttgtggaagatgtgtggaagaaggggaatggaatcatgtatgcggatgacacagctggatgggacactaggataacagaggctgatttggaggatgaacaatacctgcttgaaaagatgagtggcactcacaagaaactggcttgggctattacagagttgacctacaagaacaaggtcgtcaaggtccctagacctggacctggaggaaagattctgatggatgtgattgccaggagggaccaaagaggttctgggcaggttgtcacctatcccctcaacactggaacaaatctcaagacacagttaataaggatggctgaaggcgagggcataatcaccccagaggacacactccaactcagtcacaagaatgagaaaaatttgagggaatggttgtgcacccatggtgctgaaagacttggtagaatggctgttagtggtgatgattgcattgttgcgccaattgatgagaggtttggcaacgccctaagtcatctcaatgccatgtcaaagattagaaaggacattgatgattgggagcccagcaagccttggatgaaatgggaggaggtgccattctgctcccaccatttccaccatttgctactgaaggatggcagaagaattattgttccatgccgaaaccaagatgagctgattggaagggcccgagtgtcaccaggaaatggatggatgatcaaagaaactgcatgccacagcaagtcctatggtcagatgtggctcctcatgtatttccataggagggatctgagattgatggctaacgcaatatcatcatgcgttcctatcaattgggtgccaactggaagaactacatggtcacttcacgctggaggagagtggatgacctccgaggacatgctggaagtgtggaacagagtttggattttggacaatcctcatatgagtgacaagtcagtaatcctagagtggagagatgttccatatctggcaaagagtgatgatatcaggtgtggatcattgatagggacatcacagagagcctgctgggcagctaacatccgttctgtggttgagaaaatcaggcatttggtgggagatgagaagtacaaagactacctgcactccatggacagatatgccctggaacactccgaaattggctgcttgatataaattaaagcactccattaaaccaaccaaacactccttcatcaaacaacactccatatttaaagtgtcaggccgggaaaccgccatggctaagctctgaggccatgcagtctgggagagcagcacattcttgcccacagttgtgcttaattacatttttgggagcctccctttgtcatgcgatgcatggtggcaaagcgacgaggactagtggttagaggagaccctccctgggctatgcatcaagtcggaccgtttctacgggaagctgtaaaccgtactgtccgtgacagcattccgaaaggttgggcgaagctgtaagcctgtaaaactttggagcctccgctctgcgacccgtgtaagcagagtcgatggggactagtggttagaggagaccctccacagcaaacaacacacacggatcacattgacaccagggatagaccggagattcttcttgcctctcgacagctttaggcaccgattgccaaactacgaagctgtcgagaaacgacaagaatct

SEQ ID NO: 42 - DNA, 11209 bp, Karumba virus
  misc_feature (324)..(324): n is a, c, g, or t
acaagccamggccgccatgagtccgatgataaagcatgctacaacatgcttgttgttcctagttctttgtcgagtctccttgcgtaccttacgtcccagtgatcgcaagttgcgtaccaactcattccaaatggtgaccattgcgacaaccagttttaacaaagtctcgttcaaatctccagaaaccatattgagtgcycggcgaagagawgatgtttttaaaaaacctgcctgtgttttcttggttattttacctgttttcactcacttggttggtttgtttgaaatccatttcttttaactatcgaytttacgttrcgtttngactatgcargtcaagaaaataaagatgcgtggtggaggaggtggaaagctcggcattaaagggataaaaacatcwtccctgcgtcgggcactcaatatggtctctggagatttgaatgagaccttgctgaaactggtcatcgctatgatcgccatttggaatgagttactacgtaacttgcgrtcattggggcgtagggttcgcaaggagactcgacaaagaactggaaacaacaagcatgttgtagcatgctttatcatyggactaatggcggccttggcttgcgccaagaccatgaatggaataatggacaagggtgagcacgtttggaaagctgactggaatgttgactttaccaatgtgaagctccccaaggacttctgcggatctggaatacacgtggagaagatgtgtcctcaggttgattctttgcaagatgcaacaatcgactgcgcaggaagacatgaccaatttctcctgtcctatacacgatgtgcggctaagaatcgtgtcaaacgtggtgaacccggagtagtggaaccgaaagtcacgaacatatggaccataacgttcaatgatgagttgaacagcatcattgaacgtgtgagcgggatgctgaagaacaatcgattgatggcaacagcagtcatttgcttagttggggctttcaagaaatggcctacatggctcgtcgtgcttttggttttactgccttggactgtcgtgcaggcatcactggccgatcctttcttaattctgccgaagggtgatggtttggtaaaaactagattatacccaggacagatttcatcaatttccacacacgttggggtactggacatctcttatatggctgtggacattgaggaggggcgactcgttgaaaggttgatgtcacattgcgaagtaaatggaacttactcacaggattgttgcgctttgggatgcaacttggacttatctaagttaaatgagcggaacagggcctgtcaaacggctacctacaatcgcgggtgggctacgggatgtccagtttttggactgggcagtgtggccacatgcgttgaggtcgcgtgcagcgatagtgtggaggtgtccgaactgacaagccagaacatccggattcctctatctctacgtttgcagcatgaagagctgaatgtgaccatgacaacagaggcgccagttacttcaaagttctcacatcacggggtggtatccatctcttgtcaaattggcaatcctgggttcttggcacagcagtacgtgctgagcaatgggaagcataaagcaatgtttcccatcagtgcggtatcaggttggcctggaatccgtgagattggtggacagtacaggaacgtggatggctccgtcaagtgggggcacgttgaagcgaatgagattaaggtggccgctgtatatagtgacagcatccaatggaagactggaatcccgataaagacaggtattagagacccactgtatttgtactgtgaagtgtcgctaactgacttgactttcaagaaaataagagcatgtgaatcgcctgttgaagtttcgttcatggcaggacctacgggtttggatggtcgrctagaaattgggttgcttgagcaagtcaacaaaacatgctcaataacagggagctgtgaaggttgtaccttaccgcacccaaccagtgtcatttcgacttctgacaagaaaggccacatgcacgtagaatgtcgcacggggacatttacggcaatattcggaaagcaaaaattttctttcacctgtcrracwagttacctcagaactatttgggctacgactgcccaggcgattggaaattataggaaattcggactggatgcctcaggaggaccatttttggacttatggaataagataggtccaaatttctcccgtttggaggttgttggaatccttgttgtggcagccttgttaattgacaaaagactcttacttctcctggctatttttggatacgtcacatacgtgcgagctgatgtgggttgtggtattgacctatccagaaaaactttttcatgtggtgagggcatattcttgtggaacgacctttcatcgcagacttgggcttatggagttgaggtcgtagaaaccaaactgctggaagcctacattagtcagatgctgaaagagaggacgaaagtctgcctactgtgtgaggacatcttgcaatgttcagcagcccgacgcttagcagcggttgtggctaaaagcaatccagatgtctattacaatgattcattgtcatacggagctgtttttcccatgcgaaagaaaagccaaataacgataacagctgacggccggtcggctgtggttgcctccttcgtaatagaaggaatgataaccaactcagctcttggcaaattacaatggaacgtgtggaatcctcggccaacagcggaggctatggacgacaaagtgatccgagttttaacaacagggtctaacataacgtctgtatgcagtaaagccattggttttgagtacgttttcgaacggtttactaggaagatgtatggctcaagcgtcctagtgaaaagcacttcacacatttcccacacttgccctacttatttggctggtgctgccatcaaaaacaacagaacaattcatacggatgggttcttgtggatggatagtgcactgcaggcaaatggtacataccgactcagttcactatcagtgctccagagtcatgagtgtgagtggccggtgacccataccatcaacccaacggacccaaaggatcgctctttgttcatgccagcgaggtttggagctcctgcttcacgagctaatcatatgccaggatatcttacacagcgtaccattccatgggataaggcacccataaagctgatttatggagtagcacctggaactacaattaaagaatttccaacgtgtgacgatcgcggcgatgctctgcccatcctttcacaagaaactcgtgagtggtgttgcaaaacttgtttaagcaaagggactccgccgtttcacctagtcgtagatgggtctttgtactacccagaagaggtcagaccgatacccataccaacgaagatcacggaatctgtagctcaacccgtaacgcctccacctgtcatgaaaacgatgggggcagaagcgactcaggattttcagatggggccaggggaagggacatttgctcgcctggccctcctggcattggccttacatctaatatcacaaaatacgcgtcatggatggatcacccgggtcgcgtgtgcagccatgcttttctccgtgactggcctyccctatcacctccggtattggtggccggttattggtttctcggttttaaagaatgcgtcgggacagtctttgctagtgtcgctgtggttggcgttacacactactggtgggcacctcgtttgtttaggttcactcctgcggcaaacaagatggtgctaccggctccaatccctaatgatgctggtggcgtccctatctctgtaccggttccgggggataacttggctcatgaacatcatagacctagtggctccgttgatatcaatatcttttctctacaaagcaagaaccctacttctaggggaagttgtcttaattgggagcgggttagctctttcatggggaaacgccctcctaactctaggagtattatttgggacccacatggtgattgcctcgctgagaaaaacagcaaacgcattcgagccaggactacgtgccaacatctcattgtgcaacttcccacaacaggttgtgagggacatgtggactgtattaaagaactggcgcagagcacccgcaccttggcggagctctgggagaacacatatctcacagctagcggtttatctcctgctgttgggcctcgcttatgcgttccaccttttgaacttggaagttctagccggagcctgcgtcttaatcggattcctctggattttgatgggagaaatgctgacctcgggagaactagaactgcggagggtgtcggctctggagattcctcagggccttgaaaaaatygtcatagatcgagacttccaaagcgaatatgggcggttcacagacgcgggtgtcaaattggacaacttcaatgacgaaacgaatgtcaagttcagcttactttccctaggatttgtggcggctctcatcactgtaaacccagtgtgtggattgacaatcggattcctaatatggatcttcacatcatgccctctcgcaaaagacttggccatggcagcaagctgcttccgctcggatgatggttttgctgtattaataccaggggtgaaggaggtggctattgggacaagattcttcacgttatccgatggcgtttactccgtttgcagacgatcatggaatggactcagtcacgtaggagctggtgtggcgaaaaacaatgtcttccacactctttaccatgtgacaagaggtgaggcgatttcatgggctagtgaaaaagtaggacctacgagtgggtgtgctttgagagacgttgtaacatatggtggagattggcagttcccgctggtcacggaagatgaagcggtcgtgaagattgtcaattccgacctaactgtctctcattgctacaccaatgtcctcagtctcaatgttcaaggtgaagagtacggagtgatagggcacgatttcatggaaggttcttcaggttcaccggttttttcttcgcagggggaaataatgggattgtatggctatggattctatgaccgtgagaaccggtacaactctctgatttcatacatgaagatggaaaaagaagaggagaaagtgaagacgacggaagagcaaccaacaatgagggggactaggacgttcatcaactggcatccagggaaagggaagacccgtaaggtgattctcgaagaagctgtcagacatgtgaacgaaaacaaacgcctactcattttgacacccaccagagtagtgatgacggaagttctacaagctttgactggaaatttgcccttcggagttcgtgttgggaagcacttgagtaaaagcagatcatttcagattactgtcgcttgtcatgccaccctracaagtcatgtgcttcaacatggattgaagatyaacttctctactgtcatcatggatgagtgccactttctggaccccctgtcaatagctgcacgcggtatcatggagcatatgcattcgaagggggctgctctcatgtatctcagtgctactccgcccgggaaagctccacaagctggttcaaattaccctattatagacgtaccatctatgcctagggatgttgataggaattttgtgacatcccaagctggggrcaaaaccatagtctttgttccaacgattgctcaagcacagaaactgtccgatcaaattccaggctcagttgttttatcacgcgaaactttcgatgtaaacatgtcaaaagcggctaacccggaaacaaaagtggttatctcaacagagatcagcgaaatgggggccaatctcggggtagatactgtcattgacactcgactgtgcgttagaccagttgttgatggacgtttcaaagttcggttggtgaaagtcccaataactcatgcatctgctgtgcaaaggcgtggtcgaactggacggaggcagccagggcggtacatctttgacgacaaggttgaaccgtctgacgagtgctcacattgggtatgttggagggaggctcagatgctcctggatcagcttgatatgacaccgatgccggaggaagcggagaattttgacccaccaggccactataaactcctttcggaccagcttaaacagttcatggagctgctcacgacggagatgcctatttggctagcgtggaattgggccaacgcgagttcctctcgacacacggtgatttttggaggatctgaagtcactgacaagacgacccctgttatcactacaccatcagggaaacaactatataatccacaatttgtcgacgaccgctttgaggcagatgatctaactaagtttcacgccacgatccaaaaatatctgaggatgcgagctcacattaactgggagggattagcccagggcttgtggcacgtcgtgacaaagagcgactcatccatgtttaaggtcgcgtttcagaacacaatggagcggttacatgacctatcgcgctgggatgacgactccctccggacaagtgatatgaccgaatcagttggcacgtggattatcgtcatgcttacagcygtgtcgacattcatcatctcactcttaatttttgcttgctgtcgrtgttgcaaatcgtccaagactactaggtcccaggaagttgtttacactrcaacagtcgcggaacgcaatgtcagtgggctttggagtagcatgacagttccagtgttggggtgggttgctggaattccaggacctattctcttcgttgtggcagtgtgtttaggtcttgtttgcgccttcatgtgcaacagcgcgacgcgaagctacgtggaccacaccctatcgtggtgggttatggttctatcatgcattgtggcaggcctagtcgccttcgaactcgacttgatgcctcgtactttcgctatcctttcaagagtggctgctaccggggctagatttgacactggaccaagcgtggaacccttcatcgttactgggagacatgtaactgttgaactctgggtrgtcatcatggcgatgtatttgacagccttgatcattgcccccatcttgaagtcatacatccaggggaagtcgatagctgctgtcttcgcgaatgaaccagttgcctccgcgtacataggaggaatgaggctgacaaccatctacgcgttgcaagcaacgatttgtgtaggtcttttctacttccacgcaaatctcccatcttgtgttgttgccagtgttgcttcgttcttgtttctaatggtatttgcttttgacgtaaagtatgccttctccccggctgtcgtccgagctttggaagccaagaataacaaacgcgacacggatcgaccatccctagaamgagacgaagaaacgaagggacgccaactgtactacacactatctgttgtcatggttgcactatgggtgaccatagtacgagaccaattaaccttcgtcacagctgccggtgtagggttgcatgccttgatgtgtttaatcgttccagatcatccattccatcggaatatcaaccaggggattgtgacaatgttgttcgggttcttagtggaacctgtraagtggacattcattgtcgggttcttcctctggggagtgatgcactacacaagcccaaactcgtaccggtcatcaaacaagggggacgccatgaacgtgggaatgaagtggaagaggctgctcaattccttgaatcagaaacagtttgacgcgtacaaatctcgctcggttgatgagactccaagaggtgactatgtgtcaagaggaggcctcaagatgcgtgagataatggaggtgcacggttgggaaccaaatggaaaagtggttgatcttggatgcggacggggaggatggagccagcatttggcgatggatcgtcgggtcacggagatcaaaggttacacccttggcggcagcaatcgggaaaaccccgaggtgttcatgacctatggctacaacttgtgcacgctaaaacccatggttgatgtatataagttggagccatttgtcacgaacactgtcatttgtgacataggcgagagtgatccgtcggccgtggtggaaaaaacacgcacgctcaaggtcctcaccctgttggagaattggttgacagtctcaaaagaagccaatttcgtttgcaaggttctttcaccgtatcacactgaagtgctgaaaaaactggaaactcttcagcatgtgtatgggggacgccttgtcagactgcgcttgagtaggaattctactgcggagatgtattacatatccgggccacgatcgaacatggtgaaggcggtgtatgctacactgagagctctaacgggccgattgtcattgtatgacacgccttttgaaagcctgccccctacattgccgacagggacacgtgccgatccgaaggccaaagccaaagctgctgatttttcattattggccaggcgcatccagaaacttcagcaggaaaatcaacacacttggttccatgataaagagaatccttacacatctttctcctatcatggttcttttgtcactgacgctgtgtctggtggtggacaaacagtcaatcccatcattagaaggttgatgtggccttgggagcaagtggccaaagttactggctttatgatgactgacgtgtccacttatgcccagcaaaaagtccttcgrgagaaggtggacacatatgttgaagaaccagaccaccgtatgaagcagatcaacagacaactagctctattcatcgcggacttgtacaagaagcaaggattgagaccacgcatcctgtcaaaacaagattttgtggctaacgtacgctcagatgcagctgttggtggatgggctagtgacatgccatgggcagacgttgaaggggccataacggatccagttttctgggatatggtggaccgtgaacgtcagctacatctcggtggtgattgtgaactatgtgtctacaacaccatgggcaagaaagagaagaaaccggctgtgttgggcaaagccaagggatcacgcacgatatggtatatgtggctcgggagtcgttttcttgagtatgaagctctgggatttctgaaccaagaccattgggtctcgagagaccacttaccatgtggcgttggtggtgtaggtgtgaattactttggcaactacttaaaggagatcgcagagaaaggcaaatggttaattgccgatgatgtggcgggatgggatacccggataacagaatcagacattgaggacgaacgttctctgttgttgtccytggttaaagatccgtatcacaaagctctgatggactccatattcaccatggcttatcggaacattgtagccctcttccccaggaatcataagaaatttggaagtggcacggtgatggacgtagtttcgagaacagatcagcgtggatcaggacaagttgtgacttatgccctaaacaccatcacgaatgcgaaagttcagctgggacgctcgcttgaagctgcagggttgctggaagccgatgataggactatacaagtttggcttcgcaatcatggagaggaaactttaagaggaatgaccgtcgctggtgatgatgtggtggttgctaccaattcggactccttccacacttcgcttcattacctgaaccgaaatagcaaaattcgcaaggacattggaccattggagccatcacgccggtgtgayaactgggaggaagttgaattctgttctcaccattttcatccaatcacgttacaagatgggcgagttctaatagtgccatgtcgtgagcagaatgaaatcatcgggcgttctaggctccaaaagggcggcattgtcagtgagagtgagggagcttgcttggcgaaggctcacggacagatgtgggcactgtatttcttccatagacgtgacatgcgtttagcttacgccgccatcacagcgtgtgtgccgtcgcattggttcccgaaagggaggacttcttggtcagtgcaccaaaaacatgaatggatgacaactgttgacatgcttgaggtgtggaacaatgtctggatacacgacaacccttggatgacgaacaaagaaccagtctcgtcatggagcatggtaccatatctccctaagaaacaggacattgcatgtggcagtcggattggaactactgaccgcacactatgggcgaaggaaatgccggagcttgtctccaaattacgacgtgtcttggacaaacacgaaggaccacaacaatatactgatggtttggctattttgggccgataccaacagtcccccggaaacacggctgacatctacgtgtaaagtggtcttagggcagcacattagtatagctgggaaagtagggttacaatgctttcttgtatgcaactgatgaggtgagttgcgacacctccctgtgagcaacctgttcaaacttttgaagaagtttgaccaaacccggaaatygacaaagtcgttgaagtacagcacaacgattcacttaaaaggctgtacatagagcaaaatccataacaacatcatggtcattctcttaccatcaggagagtggatgaaatgagctgctcactcatttcacaatggcattttagaaataatttgaccattcatattttaccattatcaaaatggactccattgcttgcacaaccaatcctaaactggatggaacgcgagtaatggtggcaaaggagttgggagcactcctcatatgacaagggcaacacarrctatttattgcctgaggtggcgctgctcacctcaggcaataagttgcctgtgttgcccttgtcatatgaggagtgctctcaactcctttgccaccattgtttgcgttccattctgttaagaattggttgtgcaagcaatggagtccattttctgtaatggtaaaatatgaatggtcaaattgattaaaaatgccattgtggaatgagtgagcagctcatcccatccattctcctgatgttaagagaatgaccatgatgttgttatggtttttgctctatgtacagccttttgtgtgaatcgttgcgctgtacttcaacgactttgtcagtttccgggtttgatcaagcttcttcaaaagcttgaacaggttgctcacagggaggtgtcgcaactcacctcatcagttgcatacaagaaagcatwaag

SEQ ID NO: 43 - DNA, 10893 bp, Parramatta River virus
agtttttaaaagttaacccgtggttttaccctagtttcggtgaatttgccaattttacggaataactgtttgaaaggttcaaactctggtgtccaacgtttgtattaaaatgagtggattaggaggccttcttcccctccgagggaagaaaaagaaagcccctgtgatacaatcacagggcagggtcttgccgaagagcgactggaagggagctccgaaacaggatctaaataaaaagaaagcgaaaaaggacgagacgaaaggccagaattggccaagaagaattaacccccggactggacaatggtcggcaattgagggctctggtgctcggctgtggagaagcattttctctacagacttgatcggaggcttgttgttgttgatcgctattttatcaaatctctacgaaaaggttagacgtgacataacggaattgaaacgcagagtgactcgattggaaaaatctcgagctagtttgattttgaccccaatggtgttgctgtgtctggctatcctcgcggcaggcgtgacaatccaagtggttgtcactactgatgcacgaatcgagctttggtctgaccggaagaactttacagctcacgctcacctcgtcaaggttcctaccgacgtttgcaatgatggggtgtttgtaacaaaacattgtcccaaagttgagaagttgagtgaccttggcgaaatcgattgcggttcatcatggtctgaatttaccttgacttacacacgatgcgtaaccttggaaagagcctcacgtgcggaagagaagggaaagacaatgctggggcagttcaaggaggatctttccaccctggaaactgaggcttttttgctgtttaaaaaacatgcgttctcgaccatcctggttttgctagtattggccatcgttatgaagtggcccgtgtgggttgtggtaatactggggattctagcgtggaacgtcgtgaaaggtgagtttgttgagccattcttggttttaaaacatgaccacagtactatgctcatgaccagactgtacccaggagaaatcgctcacgttgcaactcctgccgggttggtggacattcgtgttagccatgcccaaatttttggaggtcaacgctttcgtgagttactgagcgactgctctgtgaacgcttcgtattcgaccgacatatgccccggaggatcacaacttgacttggaatcgatcaaaggtcctggacgtgtctgcatgaccgctccgtacaatcgaggatggggaaccggatgtttcaaatggggaattggagctgttgccacgtgcgttgagttgaactgcacacgggaaacaaaagttgatttgttgacaaattctgctattgtggccaacgtgacagtcaatttccactcgaccaatgacactaaactccttgtgcctgacaccccaattacgttgaagtttgggaagttaggaacgatgacaatgacgtgtcgtttgggaaatgaccgcattgctaacgatttttaccatgtaactgacaatattgcatctggactgttccagaaagctttgattgatgcgtgggaaggaccctccaagatggcgaaccacattagcggacatgaaaaagtcgtgaagtggggtcacattctcccaaatgagatcaaggtcagcaagatcattgaaatggagttagattgggaaaaagcgatcaccacacatgatggattttcgaacacctatttttggtgtcaagtggccgtgaacaagttggtcgttgggtcatttgcctcatgcaagagcggagcgaaggctagcttcatccaatcctcgtggggttttgatggtgtggttgaagtgactttggatgaggccaccaaaaccatttgctccctacccctgacatgtaccggatgtagcttgttggctacaaaagtggttttccttgagggaagccagcgggctgttgggcacgtggggtgtggaaatggaacatcaatgttgacagtaggaacgacaaaggttgggatccaatgtgtggtcacaccggtgtcacaaatttggaacttcgtgactcacgcttccggacgatatgcgaaacttggttttggaggagttggaggagctttccatgatctgctagtgaaggttggattgaccttcacctgggattcatggaagatcatcaccgtgttgtctggtctcgtagtggcttttgccatctttgatcggaagttggtgatcctgatcattatcctctgtggaatcgcttatacccgagctgacattggatgtggcattgattttgacaggaagacctacacgtgtggaagcggtctattcgtgtggaagggtttgggaaaatacccaacggccgaccattctgttgagtttgcctcatatgattttctatcagcgtacctccaggagcagtttaagtctgagaagaaggtttgtattatttgtgaagacattgtccagtgtgaggcagctagaaaagcagccgctgcggtgtataaaaacctaggccacccgtttgtctacgtgaacacgtcggactcctatggaaaagtatttgccgaaatcccgaaaagagtccacactgttagtgtgggagtcgacgttgtggaaatggccatgatgactagggagaacaaaccggttggaccgtttggtgacttaccgcgtagtatggtttcgtggaagagtatccctgaaacagaagagcacccagtgttgagagtgttgacatcttcaagtgattaccagaaggtatgtggaaaagcgattggattccagtatgattttgttggataccgtcggaccatgtatggatctaatgtccagttaaaaatatcaaagaaggtttcgattgaatgtcccacatacttggcaggagtcgccgtgaaaaatgatagaacggttttcactgatggaatgttctggatgtcatcgaaacgtgagaatggaacatacgcgatcactgagttagagatggagcagtctcacaagtgcatctggccagaccaatacactcctgacgccactttgacgccacgtgacaatgaaatgtttgttccgcctgagtggggagggccaatgtcgaaagccaaccacattcctggttacaaaatgcagactggatttccatggaacaaagcccccattcggtttgttgagggaagtgttccaggaaccattgtcacacagattagtcactgtgatggtagagggattgcagccgaagtgaatccagcaacgcagcccaattggtgctgtaagtcctgtacaaggattttccactttgaagtcgatgggaaactctattatccaatggagattcggcccgacccgaaaggaggggaacagcaaaaagttcctgtagtggagacacccattggagatgaagaaaccgagactgttggtggatggctgggtagaatgtataacattccaggagctgagggatcatatgcggattttcgactccccaagttgccaaattcaagaccaagcgcaatggtggggagtttggtcaatctattatgcttgatgttttcaattcagatagttaccaagactatgcgggcaagaacgcttatgcgtttctatctttgttgcttggtttttatgttctttggaatgccaactttgtttggattaagtgggtttttggcgtggatgatgattctaccaatctcacacaactcggtaacaatgtgcaacctaaccgtgcatctgtgggctgtactgctaaaccagagctcggcgatgtttctgtggggcctaacgctccgatcccagatacagaggtctaccgctggacagatgctactctttaccatgcagatgttgcatcacgccatctacgcgcactcttgggtgttcgggtgggtcatcgaagtatgcttgtcagtcgggcttatgatgaacttgttaaccgtcatcgatacggttcacccgaaactgatcgcatacttgctcttcttcggatggaaaacgggcatgtgcgtagtgtgcgcttggttattgatatactcaatcaggagatggaactctatagtcgccgcggctccggccgcgggcgggtggaggtcagggtatcgaacaatgatgtcctccagtttgattgttatctttatcagtgtaggaattgcaggagttatcgcttcggactatggaggttatccggctgcggctgcggtgactgcagcattgttgataatgggaatcaaaatgtttgactttctgacgacccgattgtctcttgagttcgtatctgcaggcatgttccccgaaggtgttgaaaaagcctttgaaccggactcggtcagtgacttgtttagggcatctttcactgtagatgggataaagttgcaggaccatgttgaaccgatccccattttgtttgccattttgtacatctttattggagctgtggcctgtaaggttaacccggccctcggaatagtgtatgctatcgccatgttcgcgactcctttaccggagttaatgcgtttatacatgatgaccatctattcctctacatttcggacagacactctgcttgggatggctatcccagaaacggagccagaactgtctcaagactttgggccaatccctgatgggatttatcgggtgaacaatcatggattttcagtgaagagtcatcggggagttggaatcgtaaagaatggggtttttcacactctcatgcatgtcacgctcaatgagccactcgcgtggcaaaatcgcctagtaggaccttcaatgggccactctctcaaggactatgtcacatacggtggaaactggcaattgcctgactttgatattgttaatgaggtgggcataatggtttgtggacgggatcgttccattcagtacaaaagacacgaggttgggacaatcatgatcgacgacaagcgagtgatgtacttcactcatgattacgggcacggatcatctggttcaccaatttttgtgaacggagaacctgtggccttatacggcttcgggttccatttgtacaataggtatcgatcaatagttctgcctatcccacgtgaagaagtccttgatggggctagtaatgagggcataccagctgagcacggaaccatgcgcaacaagttttttgttgactggcatccaggaaaagggaaaacccgaaaagtgatcgttaaagaggtgttaaatgctttgaatttagcacggcggattgttgttctggcccctacacgagttgtcctggctgaaataactaaggcaataggggaaaacacatcaaaaacgccctcaaaaaatcttgctttcaccggtcacaatattgtgacggtggcttgccacgcgacgttcactgattatgttttgcgtcatgggttatcaaaattcaaagctcacgaagtcataatggatgagtgccattttctggacccacgatctatagctgcgagaggaatcctggagcatctggcaactaaacgtggagttaaagtcacgtttatgagtgcaacgatcccaggacgtgaaccttcactcgggtcgaattttgagatctctgaacaggccttgcagtttccccgtgacgtcaaccaaaggtggatagaaactgttgctaggggaaagaccgttgccttcgtgccatctcacagggtaggtgacaagctagctcgcgggtgtccccaagccatttccctgcataggaacaattttgacaccaattacagcacagctatggatgagtccataaaatttatctacaccactgacatatcggaaatgggagccaatttcagtgctgacaccgtcatagatttccgggtggcgattaagccaaagatttctagtgaatttgccgtcactcttgaaccaactccgatcacgcgatcatcgatgattcaacggcgtggtcgagttggaagacaacgacctggaacctatatttacccagttgacaaaggcgtcgaagatgcctccgatcagttggcttgttggacagaagctcagatgttgttggatcaattggacttgacaatgatggcagaggaagttcggcagtcaaacattccaggggcttacaaattagttgggcgtagcctagacatatttcggaagttgctggagaaggatgacataccaatctggctgagctggaagtgggccgacagtgttcaacaacaatactccatattgtttgaaggagaacgtcaagagaatgtcgctcgtgtcgtcaacactcgagactatgcttctctagagtataagccgaagtttgttgatgcacgattcgagcgtcttggatgggatcaacgaaagctgtcaattcagttttacatgaacactcggagcttcataactttcgccactttgtcacacgtcatttctcaagtgatcgaagctggagttgtcaattctgcttggaagcgaataggagacgttagcatcatctttactgaaggaggcgacccacatgctaaagatgaaactatcatggcttggactattctggttggaggagtgttgggggctcttggattcctcatagttgcatggggaatgaaggctgtcttgcgagtaattttcggatcccgcgataagcatcttagcgtcccaaccttagtggcggatttccaaccatacatagtgtgtatagttcccattgccctacatcttgctggggttcctataccaatgacaattgtgtttttcgcgatgcttttcttgacttatccactaatgtacaagagtgccggacaacggagttatgttgacattgacttggtgaaatggattctgttaggtggatgtattgtaactggagtcatttgctgggaaatgagattgctcccaaacatctcatcagacatttcagctattttgaataggcaaagacaaagggaagacaccccaacttttgatgcttcaccaccttgggaatggttggatttagcacagccagtccctcacaatgttgaattgacgtcagtggtgataactacattcacgacctgtctgttcttgcaccaaattgtcggatggtcatacgagtcagagtggctgaaatcctatttcgaccacaaaggagtgggtcagatcatgggtggttttcggttggacacaatttcatggggatcagctctaagcggtcttctgggcacagctacttatgcctcatggggagccattttgactgggttaggaggagcggttgtgtattttttcctgatggtttcaatgctcaagtggaacttttcgggaggagccacaactggcttagaaaacaatgtcatgcgaaacgaccgagaaactggactaggtaatcggccggcaaacgacaataggcgttccctcctgtacggtgtggtggcggctgaatgtcttgtgtggttgttctgtttcagaactgccacggatgccatagtggtggcttgtttagtgtcctattgtttatggatcatcaacaacccggctagccctcaccacaaaaacactgacttaggatcggcgtgtagtttcatcggtcttttgtactgtacatgtcctactcaaaaatgcatccaagtattgatgaggtttgctttggccaggttgaacatgaacacccgctctctggaaaaaagcgcgacgggaggccttggacaccgttggaagaagctattaaatgcgatgacactattggaattcaacgcttaccgatcttgtggagttgacgagactgagaagggtgactatgtgtcacgaggagggctgaagctgagagagataaccatgaagtatggttggaagccagaagggatatgtgttgatcttggatgcggcagaggaggatggtcacagcacttggctatggatccccgcgtaactagagtggaatcattcacgttaggaggaacagcacgagaaaatccccagccaatcaagacacttggtcataaccttatccggttcaagagtggagtcaatgtgtataatatgacgccaacacatgctaacaccatagtgtgtgatatcggagaaagtgaccccaaaccagaggtggaaacctctagaacattgcgggtcctcaaaacacttgaactatggttggccaggaatccaaacgctgaatttgtgtgcaaagtcctttgcccataccccgtggaagtcctcaaatgtctggaaacccttcaacataagtatggcggaagaattattaggtcgacgtatagccgaaattcaagtgctgaaatgtattacatttctggaggccgtaacaacatggtgaaggttatcttcaccaccctccactccttgatttcgaggatacgaactaggccggagaaaatcgtcaaagaaagtgtttctctaccagttgggactagaagcgatccagggcacaagatcaagagtatggatccaaagatgatagcaacgcgggtggaaaagataaaaaaggaacatgcggacacgtggttcgttgacaacaaccatccataccaatcatttcggtatgtgggatcgtacgtcacagatgatgtgacaccaggaggtcagactgtcaacccattaatgagaaaaatgatgtggccgtgggagactgttggaggagttgtaaatttcatgatgacggacgtgtccacatatgcccaacagaaggtgttgcgagagaaggtcgacacactatcccctgaacctccaaacgacattcaaagggttaacagatggatcaccgagttcttgtgtgcttcattcatgcgtcgagggttgaaacctagaatcctgaccatggagcaatatatcaacaacgtaaagagctcagctgccattggatcgtggagcagtgatgtcccgtggagcagtgtccgagaagctttagctgataaaagattccaccaaatggtcgaggaggaaaggaaactccacttagcaggagactgccgcatgtgcgtgtacaacaccatgggcaagaaggagaagaaaccttcagccatgggcgtggccaagggctctcgaaccatttggtacatgtggttaggttcacggtttttggagtacgaagcccttggcttcttaaatgaagatcattgggtgtcacgagacaacttggcatgtggtgttggtggagtgggagtgaattacttcggctactacctacaagaaattgcacggaaagggaagttttttatcgccgatgacatagcgggatgggacacgcggatcaatgagagtgacttggccgatgaggaatttctcatcatgtccctcatttgtgacccataccatcgatcacttgcaaaagccgtgtttcggtttgcctaccagaacattgtggccttgtttccgcgaaatcatcctgggtttggaagtggaacggtgatggatgtcgtggccagaactgaccaacgaggttcaggacaggtcgtgacttacgctctaaacacgataacgaacgccaagattcaattaggcagaatgctggaagccgaaggattactagacgctcatgaacatgtaatcaaaaaatggttaaacgacaatggtgaagaggctctctccgggatggtggtggccggggatgatgttgtagttgcgaccaacaacggaaatttttcaaggtccttacgatacctccatttgaacgggaaaattcgtaaagacattgatccgtccctaccgtccaaagttgaaacgaactgggaggtggttgaattttgttctcaccattaccacgtgatgaccttaaaggacggacgacgaataattgtcccatgccgagagcagaatgaaatcattggacgaggcaggattcaaaaaggagggttggtgacccttgccgaaagtgcctgcctagcgaaggcttatgggcaaatgtgggctttgtatttctttcaccgaagagatctgcggatggcttttctagccataacttcgagtgttccaatagactggttcccagagggccggacctcgtggtcgattcaccaaaataaagagtggatgaccactgaggacatgttgcgggtctggaatacagtgtggatccaggacaatccctggatggaggacaaaatggaaatcgaaaattggagggacattccgtacctcccgaaatccatggacctaaagtgcggcagtctcattggaacaaaagaaagagccgcttggtcaaaggatctgccgtcaacggtcacggcagttcggaaaattatcgaccaagacacgaaaaccgagaatgtctaccaagactttcttggcggaatgggccggttccaaacgtacactgaccccatggcaacgtaagaaaccatcttttccaaattagtcgaaaaattttgcccctcttcgaggggctttggcggcagcaggagattttctccggggtttcacgctccccccgatgccagtggtcacagcccaagtcagagacttggagttgtggcgggacagtgagctctgtcagtggtcaatagctcaataaatatggcagcagagcttgtctcggggattcacgctccccccattgtgagtgtgtcgaactggtttcgaaggacgtctagaacgacgctaaagttcaaatccggcaacagagagtttatgtctcggggcctcacgcaccccccgttgtgagtgaagtcctttctggccatttagtggtcaggaagggtaccgttttggaacgacggaaataagttccatggagcgacactagccccactgaggggcggttggaatgacacccaacccgctatagtgcgtcgacaggtcaattagctacctggaataagctaatgtgcagggcaacaaagttctaacgaactagggtgagtagcgtcaccccccggttgtgaaaacgattgcgactagaactaaagtcgagagtctccccaccgataggggagctcgtcagtttgttttagtccaattacgct

SEQ ID NO: 44 - DNA, 10682 bp, Cell fusing agent virus
acttcggcttagctacaccacagttttggttacgcttatattttcaaagcttaagttgtttttaatttttgccgagagaccgtgaggttgaacccggcaaggaatgaagaggaaggatttggaggcgcgaggaaaagcgccagggagggatttttccaccccgttctggggaagagaaggtaggagaaaggacaaggaaaagggaggggagtctccctcaaatcggcaagtgaccctgaatacacccatccagagtgggcgtagggcagggaaaagacagcgtgttggcctgctaggaaggctgggagttggatggggatccttcttacaggaggacatcgtccaagccctcattcacatggcattggtgcttcatgccctgttttcctccatcgaccggcgaattcgctcattatctcgacgtgttaccgctcttgaatctcgacgaaccacaggagatcctatgacgctagctttcatcttgggctttctcacagtgttatgtggatgcgtggtgattgacatgcaagtttctaccgctaagggcacggaaatttttgaaggaaagacgaaccggacagactacttgcatctggtcaagttacccgctgatggttgctggagtggcattcttgtcacaaagaagtgcccaaaagtgactgacttggcaaaggacctcgagtcaacagattgcggatcaacgtggactgagttcacattgcggtatcggagatgtgccgtgaagaaacgtgaaaagcgatcacgtgaacccccgaaagcggatctgctagctgaaatggagatcatcgcgttcaagaccattcgcgaaaataagacgattttcatcgtggccctactgtgtgtggcaatcgcgaagcgttggcccacctgggttgtgattcttctggctattggcacttggaccacagtaaagggggagtttgttgaaccgttatacacgctgaaagcggaacagatgaccatgctacagaccattgtgagaccggaggaagggtacgtcgtggccacgccaaacggtcttctcgagtttaaaacaggaccggcggagatctatggggggcaatggctgcgcgagttactcgcagactgccacgtcaacgcatcctattcgactgacgtgtgtcccggtggatcgcagctcaacatggctgacatcatggccaaggaacgagtatgctcgacccagccatacaaccgcggttggggcactgggtgcttcaagtgggggattggattcgttggaacgtgcgtcgaactccattgcgacagaggattcaacgtttcttccatcgctaggtcagccattgtcatgaacgttacggctagcttccactctgttagcgacacacaacagatggttggcgacataccgcttacatttaggtttgcgaaactcggaaacgcggcgatgacctgcaggttggagtctgagcagttgctgcttgattactatcacgttacgggaagctctcacgaggggctgtttttgcggtcgcaaattgacagttggcctggtgtgcactctaccgctagtggtcggcatggcatggagaaagttgttgtgtggggagatgctaggtccaatgagatattggtaaaaaacgtaattgaaccttcgttgtcctgggaagacgcgatcgccacccatgatggattccgtgatatctcttttgtttgtcagattatgctcgacaaactagtcagtggagcttttcgagactgtccaggcccaaaaacatccacattttcccaagacggctttgggtatagtggagtggtgataactaccctcaccgcttcttcaaatgagacctgttcgcttagcttaacgtgccacggctgtctgctgcaatccacaaaaatgatctttctcgcagggaagacaacttctcgggcatttgtcaagtgtgggaaccatacgagcaccttgctcgttgggagcacttcagtttccattgagtgtgcccttaaccctatctcgcaaggatggcgcctggctcgacacgtggtggataggtatcgacggtttggcgtgtctggtgttgcgggagtgtggcaggatctggttggaaagttttcggttggtgcctttttctccaacacaacccttctagtcattttcgtcctcgctgccttgattgacaaacgcatagcctttctgttggttttaggggggtacttttactatgtgcgggctgatctggggtgtgggattgacaccacgagaaaaaccatctcgtgcggcagcggcgcttttgtgtggaaacacttgggcgttggcatttccaatgatcatgctgtggaacttgaagattactcattcactgacttgtacataaaggatatgtttagctggaccacgaaaccctgcttgatttgtgaggatgctttgcagtgcgtagccctgcgcagagctgctttctctgctgttgggtcaatgggtcctgaacaggtgtatgtaaatgacacattggcacgtacattcaagttctccgaaacaccaaagagaaccatttccgtcaccattaacctaattcagtacaagttctcatcttatgttgcacatggacgcgctgagggtgatctggggcatctaccaacaatgtttggaagctatcccgaaaaagaggctgataaggttatccggattgtcgcatcgcggcccgatattcgccgactttgcggaaaagctgtctctttccaattcaagtttacgggcttccggcgaggcttgtatggttcaaacgttcaggttgaggtctcaaagaactcatcgaccgagtgtcccacgtacctggcgggcgttgtcgtgaagaatggccgaactgtcatcactgacggcatgttttggttggaaagcacagtgttggatggagttgcccagattacatcacttgagatgcgtcaatcacaccgctgtgtgtggcccagggaatacaccccagacacgctcagtgacccttcagaccaagctttatttattccacctgcttgggggggaccaatttcgcgagtgaaccacataatcgggtacaagacacaaactgactttccgtggaacgttagtgacatcactctcatagagggcccagcccctggcacaaaggtcaaggtggactctagatgtcatgggcgaatgcacgcacaggtaattggaccgaatgacacggaatcctggtgttgccaatcatgcacaagaatagtccactttcgagttggtgacctcctatattaccccatggagatccaacttggaaccatgtctgaagcgccagagccgaattctaaaatatttgaggaaccgatcggcgaggaaccagaaccaacagttgacgacatattgaagagatacgggaaggcaaacgctcaatcggatttccggagggtgagcccacgtgcaggagttgggttcgaccgctccctcctaaatctcctgtgcctcgctatttcattgcagcttatcggggcaaaaaccagaacatcgacactaacccgtctatttctgacgattctagcaatggcgctctttggactccccaatttgttttcatctgtggggctatctgcttgggtgttgctagtggcgtcctcatcatcgcaaccgcaagatctattgatgaatctctggatcatactacagactgggagctcagcagtcctgctgttggggtacatgatcaggaagaaactctcaatagtgctaggggtccaccacttggtgactttgatgtgcattcagttcctgttctccgccgtcgatcgctatcagaaatatctctacggtctcctagaactcatggcttcggtggtcctgctgagcgcctacaagagcgtcctgcaggctctccccccagaggttctatgtttcagcctgataatggggtggaagacagccctgtctctcgctaccgttgtgtctctgatcttcagtttgaacgctatgtacaagtacgcatgtcaatatcacaatccgaggaacggctacagagactctggcgcgaatttatggttttggactgtatccttggcgagcgctgggggaatctgggcggcggagaaagctcaccaaccaacggtggcagctgtcctagcctttacaatgatagtgctctttctttacatggaacagacgaacgtcagtatggagcttgagttcatctcagctggagagactcccgaaggagtgtcaaccgaaaatgatgacgggatgaatattcctgacttaaaagggcgctatggggaggatgggatcgtcgtgggggcggcctcatcgtctggccacctacccgagctcgtgtttgtgttcctcctaggttttgccgtgacgtccacttcatactttttgggggcgctctacctgctcatcgcaaccagcactaaccttcccgtgaccataatacggatgctgcgtatgaagctcactgccaacaaccgatctgatgatctcttgggactcggcggacctattgaaactgatctccagaccagctttcaagacattcccaatggagtgtatcgcatcgttgttcgcagcttatttggcgaccggcaacgaggggctggcttctcgaaaaatggggtgtttcacactctcatgcacgtcactcgaggtgaaccagttaaatggcgtgggcgagttgtcgttcctcactctggtagtgccttgcgcgacgtggtgtcgtatggtggaccttggcagttggacacccccactaccacggaagacctcgtgctgatggcttgcaaaccggacaagaccgttgagtaccatcggtacaggccgggagtcatgagtattgacggtgaacctgtcatgttcattagtgatgatttcggaaaaggatcttctggctcaccgttcttcattaatggcgagcccgtcgggttctatggttttgggttctatgtgaacggcatttatcgctcaacagtagcaggtggtaaaccaaccgatgtcacggagaacttggactgtgattcgaccaggcggttcgtgacatggcatccgggaaaaggaaagacgcgcaaggttattgtcgaagaaactaagaagaactatgattccaaccaacggaccgtgatcttaacacccacccgggtagtcatggctgaggtcgttgaggccttgaagaactcaggcatgaggagtgataagaacctgtcgtactgcaccaggaacctgataacggttgcatgtcacgcaacgttcacgaaatttgttcttagccatggcgccaagaaagtgcgggttgccatgatcatcatggatgagtgccatttcatggatcctatgtccattgctgcgcgcgggatcatggagcatctccacagccaaggaacaaaattgatttaccttagtgcaacaccacccggccacgcgcctgatacaggctcgaattatgcaataagtgaccaatccattagcttcccaacctggttgagtccagcgtggataggaaacgttcaaaaatccgtgggggcgaagaagaccattttattcgtcccatcgcacaaccaagctaacaccctggctagtgctattcctggatccgtcccattgcatcgagcaaacttttccactaactatgcacaagcgggtgatgcagccaccgccctggtaatctccaccgacatctcagaaatgggagcgaatttgggcgtcgatctggttatagacactcgaagagctttgcgaccccttgtggattctgccacgcgtgtgaagctggttgaaacgaacataaccacatcatccatgatccagaggagagggaggacgggaagacgggaaccaggaacgtatgtgtatcctattgatagccaaacggaggaaaatccagtgtcttgggcgtgttggcctgaagcccaaatgatactggaccagctcggcatgacttttatgctagaggaagccgcatacagccaacccccggggagattcaccctagtgggagaggatagaatgcgattttcaaagcttatggaccgggatgacattcccatttggttggcgtggcactgggcagaagctggggaccgacggcactcagccctgtttcagggcgaaggaaccggaaagatcatcgagaaccgatttggcaaacaagagtatcgaccacaatacgttgatgaccgctttgagagcgttgagtgggagacgcgcaaggtgtccattgatttctacatgaactgccgcggggggcctagcctctatgagtttttcacattgattgattggactgacatatggaggagaacgacatctgctctttgggatttgagtgacgtcatgaatggagaactgcgtgaccggtccacaactgagcgctcccttaccgtgctaatggcttttgtcttgggcgtctcaattgtgctctcctgtttcatcgctgtctgggcattgtgtttcctattctccttgtttaggccgcgaaaggtaacttatgagcaaatgccatctagtgacccacttagcggtggtgtcttggtgtcaacccctagcctcctttattatatgggagtccccttggggttctgcgtcgtcatatcactggctatgttcttggtgtacccagtattgtacaagtcaattggaaatcgcagttacatggacagcgatttggtaaagtgggtcatcttgggatcatgtctgatctgcggagtgctggcttgggagatgcgaatgttcccgaacatacgtggcgacctcatggagctcgtgaaagctgtcaaggagcccgaggaggtcgtgaattccgggccattttttccaagttgggaaatagcgcggggaaagggagctacaatgttggactctctgcaggtattcttcttcataacagtgttgtcaacaaaattcttgtactggttccaggagaactggactgcacgaatgtacgccatgaaacatccggagatggttagctcgattggtggattcagatttgatgaaattccattcagggcagtccttccctctggttttgccattgtcgcgattgctagcctctcaagtgtggtggtggggcttctggcagctggtgtgttcatggccatcatgtactgtcagaacaagtggaatgccaccccaaagatcttgacagcattggacgctcgcgaccagagacatgatcgtcccactgaaatcactagtagagtgccactcgaaaacactcggtccatcatgtatgccttttgcttgatcttcagcctgttttgggctttctgcacacggtctcctggagattttctccgagggtcattggtggtcggggctagcatgtggcaaattctccatccccggtcaaagatccatgatgtcatggattttggctccatggtgtctgccatagggttgctagaaatgaactaccttttttataggttcatgcacattgccgctagagccttgggcgcggtagctcccttcaaccagtttcgagctctggaaaagtcaacaacgatcggtctgggaatgaaatggaagatgactctgaatgctcttgatggagatgcattcacaaaatacaaatcacgcggggtaaatgagacggagcggggtgattatgtctctcgtggcggcctcaaattgaatgaaatcatctcaaagtacgaatggagaccgagtggtcgagtggtggatttgggatgtgggcgcggtggctggagccagcgagctgtgatggaggaaacggtgtcctccgctctcgggttcacaataggtggggcggaaaaagagaatcctcagcgattcgtcacgaagggatataacctggctacgctaaaaactggagtggatgttcataggctcaccccattccggtgtgacaccattatgtgtgacatcggagagagtgatcccagcccaatcaaggaaaagaccagaactctcaaagtcttgcaattgttagaaaattggctcttggtgaacccgggagcccattttgtgtgcaagattctatcaccatattctcttgaagtccttcggaaaatcgagtccctccaacatctgtacaatggcaggttggtgcgcctctcccacagtcgaaatagctcggctgagatgtactacatctccggggctaggtctaacgtggtgcgcaccacatacatgacgctggccgccttaatggcccgcttctcccgacacttagacagcgttgtcctcccgagtcctgtgttgcccaaaggcacacgggctgacccggctgctagtgtggcatccatgaataccaacgacatgacggaccgtgttgaacgcttaatgaacgagaaccgtggaacatggtttgaagatcaacaacacccctacaagagtttcaagtattttggatcgtttgtcaccgatgatgtgaaggtaggagggcaagcggtgaaccccctcgttaggaagatcatgtggccatgggagactctcacgagtgtggtggggttttccatgactgacgtgtcaacctactcacagcagaaggtactgagggagaaggtggacactgtcatccctccccacccacagcatatacggcgggtcaacaggacgattacaaagcattttatccggttcttcaagaatcgcaacttacgaccgcgtattttatcaaaagaagaattcatcgccaacgttcgaaatgatgcggctgtaggatcgtggagcagggatgtgccatggcgagatgtgcaagaagccatacaggaccagtgcttctgggatctcatcggaaaggaacgggccctccatctgcaagggaagtgtgaaatgtgtatctacaacaccatgggcaagaaggagaaaaagcccagcctagctggtgaggccaagggctcaaggaccatctggtacatgtggcttgggagccggttccttgaatttgaggctctaggctttcttaatgcggatcactgggtcagtagggagcacttccctgggggagttggaggcgttggtgtcaattatttcgggtactacttgaaggacattgccagcagaggaaaataccttttcgcggacgacattgctggatgggacacaaaaattagcgcggaggatctggaggatgaggaagctctcctaacagccctcacggaagacccccaccacagagcgttgatggcggctaccatgcgactggcatatcagaacattgtggccatgttcccacgaacacactcaaaatacggcagcggcacggtgatggacgtcgttggccgtcgggaccaacgtgggtcagggcaagtagtcacatatgcgctgaacaccataacaaatggtaaggttcaggtggcgagggttttagaaagtgaaggactactgcatgcggatgaatcggtgttggatgcgtggttggaaaaacaccttgaagaagctctcggaaacatggtcattgctggagacgatgttgttgtgtcgacagacaatcgcgatttttcatctgctctcgaatatctcgagctgacgggaaaaactcggaagaacgtcccacagggagctccctccaggatggagagcgactgggaaaaggtggagttttgttctcaccattaccatgaaatgtgcctgaaagacggcagaatcctcatagcaccttgcagacatgagaacgaagtgcttggtcgtagccgattgcaaaagggaggggtagtcagcatctcggagagtgcttgcatggccaaggcctatgcccagatgtgggcattgtattttttccacaggcgtgatttacgcctaggtttcattgccatctcgtcggctgtgccaaccaattggttccctctaggacgtacctcgtggtcagtccaccagcatcacgaatggatgaccactgatgacatgcttcgggtttggaatgacgtgtgggtgcacaacaacccgtggattctaaacaaggagtcaattgaatcctgggatgacatcccctacctgcacaagaaacaggacataacctgcggaagcctgataggggtcaaggagcgcgcaacgtgggcacgagagattgaaaatagtgtcatcagcgtccggaggataatcgacgcagaaactggggtcctgaacacctacaaggacgagctctcagttatgagtcgatatcgaagaggaaatgatgtcatttagacgaaatcgaatagagccgtgaggaaccagcatcctcccggccacaggagcagggcatgaaaatgtcgggcatgacgaacccgctcccccgagtcccctggcaacagggtgtgttcccttatggagcacgttcgagcagggcacattagtgtcgggcgtgacgcacccgctcccctcagtcccctgtgcaacagggagggcacttgtaacccccgtaggagggtgcccgcttccgtcctacaaaaacctctgatcataggtacctgatctaagatggtggtggcggcccatcttatcatttagctagctgatggtcttaagcatccctcccatggaatgggtaagagaagcctgcaaacaaaactggatggcaccagtgctcttacaaaatggcagccaaagcgatccagagctttcaaaactggacggggcaacagggagaaatcccggggtagcgaacctcctccgttaatgtgaaaaagtatggggaaagaactcatcttaacctcccaccgttagggagttttgattatcttttctataccatagatgc

SEQ ID NO: 45 - DNA, 11022 bp, West Nile virus KUNV subtype
agtagttcgcctgtgtgagctgacaaacttagtagtgtttgtgaggattttgaacaattaacacagtgcgagctgtttcttagcacgaagatctcgatgtctaagaaaccaggagggcccggcaaaagccgggctgtcaatatgctaaaacgcggaatgccccgcgtgttgtccttgactggactgaagagggcaatgttgagcctgattgacggtagggggcccacacggtttgtgttggctctcttggcgttttttaggttcacggcaattgctccgacccgggcagtgctggatcgatggagaagtgtgaacaaacaaacagcgatgaaacatctcctgagtttcaagaaggaactaggaaccttgaccagtgctatcaaccggcggagctcaaaacagaagaagagaggaggaaagaccggaattgcattcatgattggcttgattgctggcgtgggagcagtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctgatactggatgtgccatagatataagtcggcaagagttgaggtgtggcagcggagtatttatacacaatgatgtggaagcttggatggaccgatacaagtactaccctgaaacaccacaaggtctagctaagatcattcaaaaggctcacaaggaaggagtgtgcggtctacgatcagtttctagattggaacaccaaatgtgggaagcagtgaaggatgaactaaacactcttttgaaggaaaatggtgtggaccttagtattgtggttgagaaacaggaggggatgtacaaatcagcacctagacgcctgactgccaccactgagaaactggaaataggctggaaagcctgggggaagagcattctgttcgcaccagaactggccaacaacacttttgtgattgatggtccggagaccaaggagtgtccaacccagaaccgtgcctggaacagcttggaggtggaagattttggattcggcctcaccagcactcggatgttcttgagggtcagagaaagcaacacgactgaatgtgactcaaagatcatcgggacagccgtcaagaataacttggcgatccatagcgatctatcctactggattgaaagcaggtttaatgacacgtggaagctcgaaagggcggtcctaggtgaagtcaaatcatgcacgtggccggaaacacataccctgtggggtgacggggtccttgagagtgacctaataataccaatcacgctagcgggactgcgaagcaaccacaaccggaggcctgggtataaaacacaaagccagggtccatgggatgaaggtcgagtggagattgactttgattactgtccagggacaacggtcactctgagtgagagctgcgggcatcgtggacctgccacccgcaccactacagagagtggaaagctgataacggactggtgctgtaggagctgcaccttacctccattgcgctaccagacagacaatggttgttggtatggcatggagattaggccacagagacatgatgaaaaaactcttgtgcagtcacaggtgaatgcctacaacgctgacatgattgatccttttcagctgggccttctggtcgtgttcttggccacccaggaggtccttcgcaagaggtggacagccaagatcagcatgccagccatactgattgccctgctagttctagtgtttgggggcatcacttacactgatgtgttacgctatgtcattctggtgggggcggcctttgcagaatccaactcaggaggagatgtggtgcatctggcgctcatggcaaccttcaagatacaaccagtgttcatggtagcatcatttctcaaggcgagatggaccaaccaagaaaacattctgctgatgttggcagctgctttcttccaaatggcttactatgatgcccggcaaattttgctttgggaaatgcctgatgtattgaattcattggcagtggcttggatgatattgagagcgataacgttcaccacaacatctaatgtggtcgtcccgctgctggccttgttaacacctggattgagatgcctaaacctggatgtgtacaggatcctgctactgatggttggaataggcagtttgatcagggaaaaaagaagtgcagctgcaaaaaagaaaggagccagtctgctatgtttggctctagcctcaacaggattttttaaccccatgatccttgctgctggacttgtcgcatgtgatcccaatcgcaagcgggggtggcctgcaactgaagtgatgacagctgtcggcttaatgtttgccatcgttggagggcttgcagaactggacatagactccatggccattccaatgactatcgcagggctcatgtttgctgcttttgtgatctctggaaaatcgaccgacatgtggattgagaggacagcggacatctcctgggagggtgatgcggaaatcacaggttccagtgaaagagttgatgttcggcttgacgatgacgggaacttccagctcatgaatgatccaggagcaccttggaaaatatggatgctccgtatggcttgcctggcaatcagcgcgtacaccccttgggctattttgccttcagtagttggattttggataactctccaatacacaaagagaggaggtgtgctgtgggacactccctctccaaaggagtacaagagaggggacacgaccactggtgtctataggatcatgactcgtggattacttggtagttaccaagcaggagcaggcgtgatggttgaaggtgttttccacaccctctggcacacgacaaaaggagccgctctgatgagcggagaaggccgcctggatccatattggggcagcgtcaaggaggatcgactttgttatggtggaccctggaaactgcagcacaagtggaatgggcaagatgaggtgcaaatgattgtggtggaaccagggaagaatgtcaagaacgtccagactaagccgggggtgttcaaaacacctgaaggggagatcggggccgtgactctggatttccccactggaacatcaggctcgcccatagtggacaaaaacggtgatgtgattgggctttatggcaacggagtcataatgcccaatggctcatacataagcgcgatagtgcaaggtgaaaggatggatgagccggttcccgccggattcgaacctgagatgttgaggaaaaaacagatcaccgttttggatcttcaccctggtgctggtaaaacaaggaggattctgccacagatcatcaaagaggctataaacaggaggctgaggacggctgtgctggcgccaactagggttgtggccgctgagatggctgaagccctaagaggattgcctatccgataccaaacatctgcggtggccagagagcacaatggaaatgagatcgtcgacgtcatgtgccatgcaaccctcacccataggctgatgtctcctcatagggtgcctaattacaacctatttgtgatggacgaggcccacttcaccgacccagccagcatcgcggctagaggatacatttccacgagagttgagctgggggaggcagctgcaatattcatgactgccaccccaccaggtacctcagacccatttccagagtccaatgcaccaatatccgacttacagaccgaaatcccggaccgagcctggaactcagggtatgagtggattacagaatatatcgggaagacggtttggtttgtgcctagtgtgaagatgggaaatgagatagccctctgtctgcagcgcgctggcaaaaaagtcatccagctaaacagaaagtcgtacgagacagagtatccaaaatgcaagaacgatgattgggactttgtcgtcacaacagatatatctgagatgggagcaaactttaaggcaagcagggtgattgacagccggaagagtgtgaaaccgactatcatcacggaaggagagggaagagtgatcttgggggaaccatccgctgtgacggcagccagtgcagcccagagacgaggacgcattggtaggaatccatcacaagttggagatgagtactgctatggagggcacacgaatgaggatgactcgaactgtgctcactggactgaggcacgaatcatgctcgataacatcaacatgccaaacggattgattgctcaattctaccaaccagagcgcgagaaggtatacaccatggacggggaataccgacttagaggagaggagaggaaaaacttcctggaattgttgagaactgcagacttgccagtatggctagcttataaggtggcagcagctggggtgtcatatcatgaccggaggtggtgttttgatggccctaggacaaatacaatccttgaagacaacaatgaagtggaagtcatcacaaagcttggtgaaaggaagattctgaggccacgctggattgatgcaagggtgtactcagaccatcaggcgctgaaatcattcaaggacttcgcctcagggaagcgctctcaaataggttttatcgaggtccttggaaagatgcctgaacatttcatggggaagacatgggaagcactcgacaccatgtatgttgtagccactgcagagaaaggaggaagagctcacagaatggctttggaggagctaccagacgccctccaaacaatagctctgatcgctctgttgagtgtgatgaccatgggagtgttttttcttctcatgcagaggaagggcatcggaaagataggcctgggaggcgttgtcctgggagccgcaacctttttctgttggatggctgaagtaccaggaacgaagattgccggaatgctgctgctttccctccttctgatgatcgtgttgattcctgagccagagaagcaacgctcgcagacagacaaccagctagctgtgttcctgatttgcgtgttgacccttgtgggtgcggtggcagccaatgagatgggttggctggacaagaccaagagtgacataagcggtctgtttgggcaaagaattgaaaccaaggagaattttagcattggggagttccttttggacctgaggccggcaacggcttggtcactgtatgctgtgactacagcagttctcactcccttgctaaagcacttgatcacgtcagactacatcaacacctcattgacctcaataaatgttcaagctagtgcgctattcacgctcgcgcgaggcttcccttttgtcgatgttggagtatcggctctcctgctagcagccggatgctggggacaagtcactctcaccgtgacggtgacatcagcaacacttctgttctgccattatgcctacatggtacctggatggcaggctgaggcaatgcgctcagcccagcgacgaacagccgctggaatcatgaaaaacgctgtggtagacggcatcgtggccacggacgttccagagctagagcgtaccacacccatcatgcagaagaaggttggacaagttatgctgattttggtgtctcttgccgcattggtggtaaacccgtctgtgaagacagtgcgggaagccggaattctgattacggcagcagctgttaccctctgggagaacggagcaagctctgtgtggaacgcaacaaccgccataggactttgtcacatcatgcgcggaggctggttatcgtgtttatccataacatggactcttgtaaaaaacatggaaaaaccagggctgaagagaggtggggcaaaaggacgcaccttgggggaggtttggaaagaaagacttaaccagatgacgaaagaagaattcatcaggtaccgtaaagaagccatcactgaagttgaccgctcagcagcaaaacacgctaggaaggaaaggaatatcactggagggcatccagtttctagaggcacggcaaagctaagatggctggtcgagaggaggtttcttgaaccggtcggaaaagtgatcgaccttggatgtggaagaggcggctggtgttattacatggccacacaaaaaagagtccaagaagtcagagggtacacaaaaggtggtcccggacatgaagagccccagctagtgcagagctatggatggaacattgtcaccatgaagagtggggtggatgtgttctataggccttctgaatgttgtgacactctcctttgtgatatcggagagtcctcatcaagtgctgaagttgaagaacatagaacgctacgagtccttgaaatggtggaagactggttgcatcgagggccaaaggaattttgtgtgaaggtactgtgcccctacatgccaaaggtcatagaaaagatggagctgctccaacgccggtatggcgggggattggttaggaacccactctcacggaattccacacatgaaatgtattgggtgagtcgagcctcaggcaatgtggtgcactcagtgaacatgaccagccaggtactcttaggaaggatggagaagaagacctggaagggacctcagtacgaagaagacgtgaacttgggaagcggaacgagagcagtgggaaaacctctactcaactcagacaccagcaagataaagaacaggattgaacgacttaggcgtgagtacagctcgacatggcatcatgatgagaaccacccatatagaacctggaactaccacggtagctacgaagtgaagccaacaggctctgcaagctcactggtcaatggagtggtcaggctcctctcgaaaccatgggacaccatcacaaatgtcaccacaatggccatgacggacaccaccccttttggacaacagcgagtgttcaaagagaaggtggacacgaaagctccggaaccgccagaaggagtgaagtatgtgctcaatgaaaccaccaactggttgtgggcgttcctggcacgagaaaagcgtcccagaatgtgctcgcgagaggaatttataaggaaggtcaatagtaatgcagctctgggcgccatgtttgaggagcagaatcaatggaggagtgctagagaagcggttgaagatccaaaattctgggaaatggtggatgaagagcgtgaggcgcacttacgcggagaatgtcatacttgcatttacaacatgatgggaaagagggagaaaaaacccggagagtttgggaaagccaagggaagcagggccatctggtttatgtggctgggagctcgcttcctagagtttgaggctctgggctttcttaatgaggaccactggcttggaagaaagaactcggggggcggggtcgagggtctgggcctccagaaattaggctacatcctgcgtgaagttggcacccgacccggaggcagaatctacgctgatgacacagccggttgggacacccgcatcacaagagctgacctggagaatgaagccaaggttcttgagttgttggacggggagcaccggcgcctggccagggccatcattgagctcacctatcgccacaaagtagtgaaggtaatgcgcccggctgctgatggaagaaccgtcatggacgtcatctccagggaagaccagagaggaagtgggcaagttgtcacctacgctctaaacacctttaccaacctggctgtccaattggtgagaatgatggaaggagagggtgtgatcggcccagatgatgtggagaaactcacaaaggggaaagggcccaaggttagaacctggctgtctgagaatggggaggaaagactcagccgcatggctgtcagtggagatgactgtgtggtaaagcccttggatgatcgctttgccacctctctccactttctcaacgccatgtcaaaggtgcgcaaggacatccaagagtggaaaccatcaaccggatggtatgattggcagcaagttccattctgttcaaaccacttcactgaactgatcatgaaagatggaagaacactggtgactccatgccgagggcaggatgagttagtgggcagagctcgcatctccccaggggctggatggaatgttcgagacactgcttgcttagccaaatcttatgctcagatgtggttgctcctgtacttccacagaagagatctgcggttgatggccaacgccatctgctctgccgtacctgtaaactgggtccctactggaagaaccacatggtccatccacgctggaggagagtggatgacaacggaagacatgctggaggtctggaatcgtgtctggattgaggaaaatgaatggatggaggacaaaaccccagtggagaagtggagtgatgttccatactctggcaaacgagaggacatttggtgtggcagcctgattggcacaagagcccgggccacgtgggcagaaaacattcaagtggccatcaaccaagtcagatcaataattggagatgagaaatatgtggattacatgagttcattgaagagatatgaagacacaacattggttgaggatacagtattgtaaatactttgttaattgtaaataaatattgttattatgtgtagaagtttagctttataatagtgtttagtgtgtttagagttagaaaaattttagtgaggaagtcaggccggaaaattcccgccaccggaagttgagtagacggtgctgcctgcgactcaaccccaggaggactgggtgaacaaagctgcgaagtgatccatgtaagccctcagaaccgtctcggaaagaggaccccacatgttgtagcttcaaggcccaatgtcagaccacgccatggcgtgccactctgcggagagtgcagtctgcgacagtgccccaggaggactgggtgaacaaaggcgaatcaacgtcccacgcggccctagctctggcaatggtgttaaccagagtgaaaggactagaggttagaggagaccccgcgttctgaagtgcacggcccagcctggctgaagctgtaggtcaggggaaggactagaggttagtggagaccccgtgccgcaaaacaccacaacaacacagcatattgacacctgggatagactaggagatcttctgctctgcacaaccagccacacggcacagtgcgccgacaatggtggctggtggtgcgagaacacaggatct

SEQ ID NO: 46 - DNA, 10808 bp, Zika virus
agttgttgatctgtgtgaatcagactgcgacagttcgagtttgaagcgaaagctagcaacagtatcaacaggttttattttggatttggaaacgagagtttctggtcatgaaaaacccaaaaaagaaatccggaggattccggattgtcaatatgctaaaacgcggagtagcccgtgtgagcccctttgggggcttgaagaggctgccagccggacttctgctgggtcatgggcccatcaggatggtcttggcaattctagcctttttgagattcacggcaatcaagccatcactgggtctcatcaatagatggggttcagtggggaaaaaagaggctatggaaataataaagaagttcaagaaagatctggctgccatgctgagaataatcaatgctaggaaggagaagaagagacgaggcgcagatactagtgtcggaattgttggcctcctgctgaccacagctatggcagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgctgatgtggggtgctcggtggacttctcaaagaaggagacgagatgcggtacaggggtgttcgtctataacgacgttgaagcctggagggacaggtacaagtaccatcctgactccccccgtagattggcagcagcagtcaagcaagcctgggaagatggtatctgcgggatctcctctgtttcaagaatggagaacatcatgtggagatcagtagaaggggagctcaacgcaatcttggaagagaatggagttcaactgacggtcgttgtgggatctgtaaaaaaccccatgtggagaggtccacagagattgcccgtgcctgtgaacgagctgccccacggctggaaggcttgggggaaatcgtacttcgtcagagcagcaaagacaaataacagctttgtcgtggatggtgacacactgaaggaatgcccactcgaacatagagcatggaacagctttcttgtggaggatcatgggttcggggtatttcacactagtgtctggctcaaggttagagaagattattcattagagtgtgatccagccgttattggaacagctgttaaggggaaggaggctgtacacagtgatctaggctactggattgagagtgagaagaatgacacatggaggctgaagagggcccatctaatcgagatgaaaacatgtgaatggccaaagtcccacacattgtgggcagatggaatagaagagagtgatctgatcattcccaagtctttagctgggccactcagccatcacaataccagagagggctacaggacccaaatgaaagggccatggcacagtgaagagcttgaaattcggtttgaggaatgcccgggcactaaggtccacgtggaggaaacatgtggaacaagaggaccatctctgagatcaaccactgcaagcggaagggtgatcgaggaatggtgctgcagggagtgcacaatgcccccactgtcgttccgggctaaagatggctgttggtatggaatggagataaggcccaggaaagaaccagaaagcaacttagtaaggtcagtggtgactgcaggatcaactgatcacatggatcacttctcccttggagtgcttgtgattctgctcatggtgcaggaagggctgaagaagagaatgaccacaaagatcatcataagcacatcaatggcagtgctggtagctatgatcctgggaggattttcaatgagtgacctggctaagcttgcaattttgatgggcgccaccttcgcggaaatgaacactggaggagatgtagctcatctggcgctgatagcggcattcaaagtcagaccagcgttgctggtatctttcatcttcagagctaattggacaccccgtgaaagcatgctgctggccttggcctcgtgtcttttgcaaactgcgatctccgccttggaaggcgacctgatggttctcatcaatggttttgctttggcctggttggcaatacgagcgatggttgttccacgcactgataacatcaccttggcaatcctggctgctctgacaccactggcccggggcacactgcttgtggcgtggagagcaggccttgctacttgcggggggtttatgctcctctctctgaagggaaaaggcagtgtgaagaagaacttaccatttgtcatggccctgggactaaccgctgtgaggctggtcgaccccatcaacgtggtgggactgctgttgctcacaaggagtgggaagcggagctggccccctagcgaagtactcacagctgttggcctgatatgcgcattggctggagggttcgccaaggcagatatagagatggctgggcccatggccgcggtcggtctgctaattgtcagttacgtggtctcaggaaagagtgtggacatgtacattgaaagagcaggtgacatcacatgggaaaaagatgcggaagtcactggaaacagtccccggctcgatgtggcgctagatgagagtggtgatttctccctggtggaggatgacggtccccccatgagagagatcatactcaaggtggtcctgatgaccatctgtggcatgaacccaatagccataccctttgcagctggagcgtggtacgtatacgtgaagactggaaaaaggagtggtgctctatgggatgtgcctgctcccaaggaagtaaaaaagggggagaccacagatggagtgtacagagtaatgactcgtagactgctaggttcaacacaagttggagtgggagttatgcaagagggggtctttcacactatgtggcacgtcacaaaaggatccgcgctgagaagcggtgaagggagacttgatccatactggggagatgtcaagcaggatctggtgtcatactgtggtccatggaagctagatgccgcctgggacgggcacagcgaggtgcagctcttggccgtgccccccggagagagagcgaggaacatccagactctgcccggaatatttaagacaaaggatggggacattggagcggttgcgctggattacccagcaggaacttcaggatctccaatcctagacaagtgtgggagagtgataggactttatggcaatggggtcgtgatcaaaaatgggagttatgttagtgccatcacccaagggaggagggaggaagagactcctgttgagtgcttcgagccttcgatgctgaagaagaagcagctaactgtcttagacttgcatcctggagctgggaaaaccaggagagttcttcctgaaatagtccgtgaagccataaaaacaagactccgtactgtgatcttagctccaaccagggttgtcgctgctgaaatggaggaagcccttagagggcttccagtgcgttatatgacaacagcagtcaatgtcacccactctggaacagaaatcgtcgacttaatgtgccatgccaccttcacttcacgtctactacagccaatcagagtccccaactataatctgtatattatggatgaggcccacttcacagatccctcaagtatagcagcaagaggatacatttcaacaagggttgagatgggcgaggcggctgccatcttcatgaccgccacgccaccaggaacccgtgacgcatttccggactccaactcaccaattatggacaccgaagtggaagtcccagagagagcctggagctcaggctttgattgggtgacggatcattctggaaaaacagtttggtttgttccaagcgtgaggaacggcaatgagatcgcagcttgtctgacaaaggctggaaaacgggtcatacagctcagcagaaagacttttgagacagagttccagaaaacaaaacatcaagagtgggactttgtcgtgacaactgacatttcagagatgggcgccaactttaaagctgaccgtgtcatagattccaggagatgcctaaagccggtcatacttgatggcgagagagtcattttggctggacccatgcctgtcacacatgccagcgctgcccagaggagggggcgcataggcaggaatcccaacaaacctggagatgagtatctgtatggaggtgggtgcgcagagactgacgaagaccatgcacactggcttgaagcaagaatgctccttgacaatatttacctccaagatggcctcatagcctcgctctatcgacctgaggccgacaaagtagcagccattgagggagagttcaagcttaggacggagcaaaggaagacctttgtggaactcatgaaaagaggagatcttcctgtttggctggcctatcaggttgcatctgccggaataacctacacagatagaagatggtgctttgatggcacgaccaacaacaccataatggaagacagtgtgccggcagaggtgtggaccagacacggagagaaaagagtgctcaaaccgaggtggatggacgccagagtttgttcagatcatgcggccctgaagtcattcaaggagtttgccgctgggaaaagaggagcggcttttggagtgatggaagccctgggaacactgccaggacacatgacagagagattccaggaagccattgacaacctcgctgtgctcatgcgggcagagactggaagcaggccttacaaagccgcggcggcccaattgccggagaccctagagaccattatgcttttggggttgctgggaacagtctcgctgggaatctttttcgtcttgatgaggaacaagggcatagggaagatgggctttggaatggtgactcttggggccagcgcatggctcatgtggctctcggaaattgagccagccagaattgcatgtgtcctcattgttgtgttcctattgctggtggtgctcatacctgagccagaaaagcaaagatctccccaggacaaccaaatggcaatcatcatcatggtagcagtaggtcttctgggcttgattaccgccaatgaactcggatggttggagagaacaaagagtgacctaagccatctaatgggaaggagagaggagggagcaaccataggattctcaatggacattgacctgcggccagcctcagcttgggccatctatgctgccttgacaactttcattaccccagccgtccaacatgcagtgaccacttcatacaacaactactccttaatggcgatggccacgcaagctggagtgttgtttggtatgggcaaagggatgccattctacgcatgggactttggagtcccgctgctaatgataggttgctactcacaattaacacccctgaccctaatagtggccatcattttgctcgtggcgcactacatgtacttgatcccagggctgcaggcagcagctgcgcgtgctgcccagaagagaacggcagctggcatcatgaagaaccctgttgtggatggaatagtggtgactgacattgacacaatgacaattgacccccaagtggagaaaaagatgggacaggtgctactcatagcagtagcagtctccagcgccatactgtcgcggaccgcctgggggtggggggaggctggggccctgatcacagccgcaacttccactttgtgggaaggctctccgaacaagtactggaactcctctacagccacttcactgtgtaacatttttaggggaagttacttggctggagcttctctaatctacatagtaacaagaaacgctggcttggtcaagagacgtgggggtggaacaggagagaccctgggagagaaatggaaggcccgcttgaaccagatgtcggccctggagttctactcctacaaaaagtcaggcatcaccgaggtgtgcagagaagaggcccgccgcgccctcaaggatggtgtggcaacgggaggccatgctgtgtcccgaggaagtgcaaagctgagatggttggtggagcggggatacctgcagccctatggaaaggtcattgatcttggatgtggcagagggggctggagttactacgccgccaccatccgcaaagttcaagaagtgaaaggatacacaaaaggaggccctggtcatgaagaacccgtgttggtgcaaagctatgggtggaacatagtccgtcttaagagtggggtggacgtctttcatatggcggctgagccgtgtgacacgttgctgtgtgacataggtgagtcatcatctagtcctgaagtggaagaagcacggacgctcagagtcctctccatggtgggggattggcttgaaaaaagaccaggagccttttgtataaaagtgttgtgcccatacaccagcactatgatggaaaccctggagcgactgcagcgtaggtatgggggaggactggtcagagtgccactctcccgcaactctacacatgagatgtactgggtctctggagcgaaaagcaacaccataaaaagtgtgtccaccacgagccagctcctcttggggcgcatggacgggcctaggaggccagtgaaatatgaggaggatgtgaatctcggctctggcacgcgggctgtggtaagctgcgctgaagctcccaacatgaagatcattggtaaccgcattgaaaggatccgcagtgagcacgcggaaacgtggttctttgacgagaaccacccatataggacatgggcttaccatggaagctatgaggcccccacacaagggtcagcgtcctctctaataaacggggttgtcaggctcctgtcaaaaccctgggatgtggtgactggagtcacaggaatagccatgaccgacaccacaccgtatggtcagcaaagagttttcaaggaaaaagtggacactagggtgccagacccccaagaaggcactcgtcaggttatgagcatggtctcttcctggttgtggaaagagctaggcaaacacaaacggccacgagtctgtaccaaagaagagttcatcaacaaggttcgtagcaatgcagcattaggggcaatatttgaagaggaaaaagagtggaagactgcagtggaagctgtgaacgatccaaggttctgggctctagtggacaaggaaagagagcaccacctgagaggagagtgccagagttgtgtgtacaacatgatgggaaaaagagaaaagaaacaaggggaatttggaaaggccaagggcagccgcgccatctggtatatgtggctaggggctagatttctagagttcgaagcccttggattcttgaacgaggatcactggatggggagagagaactcaggaggtggtgttgaagggctgggattacaaagactcggatatgtcctagaagagatgagtcgcataccaggaggaaggatgtatgcagatgacactgctggctgggacacccgcatcagcaggttcgatctggagaatgaagctctaatcaccaaccaaatggagaaagggcatagggccttggcattggccataatcaagtacacataccaaaacaaagtggtaaaggtccttagaccagctgaaaaagggaaaacagttatggacattatttcgagacaagaccaaagggggagcggacaagttgtcacttacgctcttaacacatttaccaacctagtggtgcaactcattcggaatatggaggctgaggaagttctagagatgcaagacttgtggctgctgcggaggtcagagaaagtgaccaactggttgcagagcaacggatgggataggctcaaacgaatggcagtcagtggagatgattgcgttgtgaagccaattgatgataggtttgcacatgccctcaggttcttgaatgatatgggaaaagttaggaaggacacacaagagtggaaaccctcaactggatgggacaactgggaagaagttccgttttgctcccaccacttcaacaagctccatctcaaggacgggaggtccattgtggttccctgccgccaccaagatgaactgattggccgggcccgcgtctctccaggggcgggatggagcatccgggagactgcttgcctagcaaaatcatatgcgcaaatgtggcagctcctttatttccacagaagggacctccgactgatggccaatgccatttgttcatctgtgccagttgactgggttccaactgggagaactacctggtcaatccatggaaagggagaatggatgaccactgaagacatgcttgtggtgtggaacagagtgtggattgaggagaacgaccacatggaagacaagaccccagttacgaaatggacagacattccctatttgggaaaaagggaagacttgtggtgtggatctctcatagggcacagaccgcgcaccacctgggctgagaacattaaaaacacagtcaacatggtgcgcaggatcataggtgatgaagaaaagtacatggactacctatccacccaagttcgctacttgggtgaagaagggtctacacctggagtgctgtaagcaccaatcttaatgttgtcaggcctgctagtcagccacagcttggggaaagctgtgcagcctgtgacccccccaggagaagctgggaaaccaagcctatagtcaggccgagaacgccatggcacggaagaagccatgctgcctgtgagcccctcagaggacactgagtcaaaaaaccccatgcgcttggaggcgcaggatgggaaaagaaggtggcgaccttccccacccttcaatctggggcctgaactggagatcagctgtggatctccagaagagggactagtggttagaggagaccccccggaaaacgcaaaacagcatattgacgctgggaaagaccagagactccatgagtttccaccacgctggccgccaggcacagatcgccgaatagcggcggccggtgtggggaaatccatgggtctt

SEQ ID NO: 47 - DNA, 10712 bp, Dengue virus type 2
agttgttagtctacgtggaccgacaaagacagattctttgagggagctaagctcaacgtagttctaactgttttttgattagagagcagatctctgatgaataaccaacggaaaaaggcgagaaacacgcctttcaatatgctgaaacgcgagagaaaccgcgtgtcaactgtacaacagttgacaaagagattctcacttggaatgctgcagggacgaggaccactaaaattgttcatggccctggtggcattccttcgtttcctaacaatcccaccaacagcagggatattaaaaagatggggaacaattaaaaaatcaaaggctattaatgttctgagaggcttcaggaaagagattggaaggatgctgaatatcttaaacaggagacgtagaactgcaggcatgatcatcatgctgattccaacagtgatggcgtttcatctgaccacacgcaacggagaaccacacatgatcgtcagtagacaagaaaaagggaaaagccttctgtttaagacaaaggacggcacgaacatgtgtaccctcatggccatggaccttggtgagttgtgtgaagacacaatcacgtataaatgtccttttctcaagcagaacgaaccagaagacatagattgttggtgcaactccacgtccacatgggtaacttatgggacatgtaccaccacaggagagcacagaagagaaaaaagatcagtggcgcttgttccacacgtgggaatgggattggagacacgaactgaaacatggatgtcatcagaaggggcctggaaacatgcccagagaattgaaacttggattctgagacatccaggctttaccataatggccgcaatcctggcatacaccataggaacgacgcatttccaaagagtcctgatattcatcctactgacagccatcgctccttcaatgacaatgcgctgcataggaatatcaaatagggactttgtggaaggagtgtcaggagggagttgggttgacatagttttagaacatggaagttgtgtgacgacgatggcaaaaaataaaccaacactggactttgaactgataaaaacagaagccaaacaacccgccaccttaaggaagtactgtatagaggctaaactgaccaacacgacaacagactcgcgctgcccaacacaaggggaacccaccctgaatgaagagcaggacaaaaggtttgtctgcaaacattccatggtagacagaggatggggaaatggatgtggattatttggaaaaggaggcatcgtgacctgtgctatgttcacatgcaaaaagaacatggaaggaaaaattgtgcagccagaaaacctggaatacactgtcgtgataacacctcattcaggggaagaacatgcagtcggaaatgacacaggaaaacatggtaaagaagtcaagataacaccacagagctccatcacagaggcggaactgacaggctatggcactgttacgatggagtgctctccaagaacgggcctcgacttcaatgagatggtgttgctgcaaatgaaagacaaagcttggctggtgcacagacaatggttcctagacctaccgttgccatggctgcccggagcagacacacaaggatcaaattggatacagaaagagacactggtcaccttcaaaaatccccatgcgaaaaaacaggatgttgttgtcttaggatcccaagagggggccatgcatacagcactcacaggggctacggaaatccagatgtcatcaggaaacctgctgttcacaggacatctcaagtgcaggctgagaatggacaaattacaacttaaagggatgtcatactccatgtgcacaggaaagtttaaaattgtgaaggaaatagcagaaacacaacatggaacaatagtcattagagtacaatatgaaggagacggctctccatgcaagatcccctttgagataatggatctggaaaaaagacatgttttgggccgcctgatcacagtcaacccaattgtaacagaaaaggacagtccagtcaacatagaagcagaacctccattcggagacagctacatcatcataggagtggaaccaggacaattgaagctggactggttcaagaaaggaagttccatcggccaaatgtttgagacaacaatgaggggagcgaaaagaatggccattttgggcgacacagcctgggattttggatctctgggaggagtgttcacatcaataggaaaggctctccaccaggtttttggagcaatctacggggctgctttcagtggggtctcatggactatgaagatcctcataggagttatcatcacatggataggaatgaactcacgtagcacatcactgtctgtgtcactggtattagtgggaatcgtgacactgtacttgggagttatggtgcaggccgatagtggttgcgttgtgagctggaagaacaaagaactaaaatgtggcagtggaatattcgtcacagataacgtgcatacatggacagaacaatacaagttccaaccagaatccccttcaaaactggcttcagccatccagaaagctcatgaagagggcatctgtggaatccgctcagtaacaagactggaaaatcttatgtggaaacagataacatcagaattgaatcatattctatcagaaaatgaagtgaaactgaccatcatgacaggagacatcaaaggaatcatgcaggtaggaaaacgatctctgcggcctcaacccactgagttgaggtattcatggaaaacatggggtaaagcgaaaacgctctccacagaactccacaatcagaccttcctcattgatggtcccgaaacagcagaatgccccaacacaaacagagcttggaattcactagaagttgaggactacggctttggagtattcactaccaatatatggctaagattgagagaaaagcaggatgtattttgtgactcaaaactcatgtcagcggccataaaggacaacagagccgtccatgctgatatgggttattggatagaaagcgcactcaatgatacatggaagatagagaaagcttctttcattgaagtcaaaagttgccactggccaaagtcacacactctatggagtaatggagtgctagaaagcgagatggtaattccaaagaatttcgctggaccagtgtcacaacataataacagaccaggctatcacacacaaacagcaggaccttggcatctaggcaagcttgagatggactttgatttctgcgaagggactacagtggtggtaaccgaggactgtggaaacagagggccttctttaagaacaaccactgcctcaggaaaactcataacggaatggtgttgtcgatcttgcacactaccaccactaagatacagaggtgaggatggatgctggtacgggatggaaatcagaccattgaaagagaaagaagaaaatctggtcagttctctggtcacagccggacatgggcagattgataatttctcattaggaatcttgggaatggcactgttccttgaagaaatgctcaggactcgagtaggaacgaaacatgcaatattactagtcgcagtttctttcgtaacgttaatcacagggaacatgtcttttagagacctgggaagagtgatggttatggtgggtgccaccatgacagatgacataggcatgggtgtgacttatcttgctctactagcagctttcaaagtcagaccaacctttacagctggactgctcttgagaaaactgacctccaaggaattaatgatgaccaccataggaatcgttcttctctcccagagtagcataccagagaccattcttgaactgaccgatgcgttagctttaggcatgatggtcctcaagatggtgagaaacatggaaaaatatcagctggcagtgactatcatggctattttgtgcgtcccaaatgctgtgatattacagaacgcatggaaagtgagttgcacaatattggcagtggtgtctgtttcccccctgctcttaacatcctcacaacagaaagcggactggataccattagcgttgacgatcaaaggcctcaatccaacagccatttttctaacaaccctctcaagaaccagcaagaaaaggagctggcctttaaatgaggccatcatggcggttgggatggtgagtatcttggccagctctctcttaaagaatgacatccccatgacaggaccattagtggctggagggcttcttactgtgtgctacgtactaactgggcggtcagccgatctggaactagagagagctaccgatgtcaaatgggatgaccaggcagagatatcaggtagcagtccaattctgtcaataacaatatcagaagatggcagcatgtcaataaagaatgaagaggaagagcaaacactgactatactcattagaacaggattgcttgtgatctcaggactctttccggtatcaataccaatcacagcagcagcatggtacctgtgggaagtaaagaaacaacgggctggagtgttgtgggatgtcccctcaccaccacccgtgggaaaggctgaattggaagatggagcctacagaatcaagcaaaaaggaatccttggatattcccagatcggagctggagtttacaaagaaggaacatttcacacaatgtggcacgtcacacgtggcgctgtcctaatgcataaggggaagaggattgaaccatcatgggcggacgtcaagaaagacttaatatcatatggaggaggttggaagctagaaggagaatggaaagaaggagaagaagtccaggtcttggcattggagcctgggaaaaatccaagagccgtccaaacaaaacctggcctttttagaaccaatactggaaccataggtgccgtatctctggacttttcccctgggacgtcaggatctccaatcgtcgacaaaaaaggaaaagttgtaggtctctatggcaatggtgtcgttacaaggagtggagcatatgtgagtgccatagctcagactgaaaaaagcattgaagacaatccagagattgaagatgacatctttcgaaagagaagattgaccatcatggatctccacccaggagcaggaaagacaaagagatacctcccggccatagtcagagaggccataaaaagaggcttgagaacactaatcctagcccccactagagtcgtggcagctgaaatggaggaagcccttagaggacttccaataagataccaaactccagctatcagggctgagcacaccgggcgggagattgtggacttaatgtgtcatgccacatttaccatgaggctgctatcaccaatcagggtgccaaattacaacctgatcatcatggacgaagcccattttacagatccagcaagcatagcagctaggggatacatctcaactcgagtggagatgggtgaggcagctggaatttttatgacagccactcctccgggtagcagagatccatttcctcagagtaatgcaccaattatggacgaagaaagagaaattccggaacgttcatggaactccgggcacgagtgggtcacggattttaaaggaaagactgtctggtttgttccaagcataaaaaccggaaatgacatagcagcctgcctgagaaagaatggaaagagggtgatacaactcagtaggaagacctttgattctgaatatgtcaagactagaaccaatgactgggatttcgtggttacaactgacatctcggaaatgggtgccaactttaaagctgagagggttatagaccccagacgctgcatgaaaccagttatactgacagacggcgaagagcgggtgattctggcaggacccatgccagtgacccactctagtgcagcacaaagaagagggagaataggaaggaatccaaggaatgaaaatgatcaatatatatatatgggggaacccctggaaaatgatgaagactgtgcgcactggaaggaagctaagatgctcctagataacatcaacacacctgaaggaatcattcccagcatgttcgagccagagcgtgaaaaggtggatgccattgacggtgaatatcgcttgagaggagaagcacggaaaacttttgtggacctaatgagaagaggagacctaccagtctggttggcttataaagtggcagctgaaggtatcaactacgcagacagaagatggtgttttgacggaaccagaaacaatcaaatcttggaagaaaatgtggaagtggaaatctggacaaaggaaggggaaaggaaaaaattgaaacctagatggttagatgctaggatctactccgacccactggcgctaaaagaattcaaggaattcgcagccggaagaaagtccctaaccctgaacctaatcacagagatgggcagactcccaacttttatgactcagaaggccagagatgcactagacaacttggcggtgctgcacacggctgaagcgggtggaaaggcatacaatcatgctctcagtgaactaccggagaccctggagacattgcttttgctgacactgttggccacagtcacgggaggaatctttctattcctgatgagcggaaggggtatagggaagatgaccctgggaatgtgctgcataatcacggccagcatcctcttatggtatgcacaaatacaaccacattggatagcagcttcaataatattggagttctttctcatagtcttgctcattccagaaccagaaaagcagaggacaccccaggataatcaattgacttatgtcatcatagccatcctcacagtggtggccgcaaccatggcaaacgaaatgggttttctggaaaaaacaaagaaagacctcggactgggaaacattgcaactcagcaacctgagagcaacattctggacatagatctacgtcctgcatcagcatggacgttgtatgccgtggctacaacatttatcacaccaatgttgagacatagcattgaaaattcctcagtaaatgtgtccctaacagccatagctaaccaagccacagtgctaatgggtctcgggaaaggatggccattgtcaaagatggacattggagttcccctccttgctattgggtgttactcacaagtcaaccctataaccctcacagcggctcttcttttattggtagcacattatgccatcataggaccgggacttcaagccaaagcaaccagagaagctcagaaaagagcagcagcgggcatcatgaaaaacccaactgtggatggaataacagtgatagatctagatccaataccctatgatccaaagtttgaaaagcagttgggacaagtaatgctcctagtcctttgcgtgacccaagtgctgatgatgaggactacgtgggctttgtgtgaagccttaactctagcaaccggacccgtgtccacattgtgggaaggaaatccagggagattctggaacacaaccattgcagtgtcaatggcaaacatctttagagggagttacctggctggagctggacttctcttttctatcatgaagaacacaaccagcacgagaagaggaactggcaacataggagaaacgctaggagagaaatggaaaagcagactgaacgcattggggaaaagtgaattccagatctacaaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggtagagggggctggtcatactattgtggaggattaaagaatgtaagagaagttaaaggcttaacaaaaggaggaccaggacacgaagaacctatccctatgtcaacatatgggtggaatctagtacgcttacagagcggagttgacgtcttttttgttccaccagagaagtgtgacacattgttgtgtgacataggggaatcatcaccaaatcccacggtagaagcgggacgaacactcagagtccttaacctagtggaaaattggctgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagtttgaagccctaggatttttgaatgaagaccattggttctccagagagaactccctgagtggagtggaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtaccaaaacaaggtggtgcgtgtgcaaagaccaacaccaagaggcacagtaatggacatcatatcgagaagagaccaaaggggtagtggacaagttggcacctatggcctcaacactttcaccaacatggaagcacaactaattaggcaaatggagggggaaggaatcttcaaaaacatccagcacttgacagcctcagaagaaatcgctgtgcaagattggctagtaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtgcccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtatggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtggtagaaaaacatgaaacaaaacagaagtcaggtcggattaagccatagtacgggaaaaactatgctacctgtgagccccgtccaaggacgttaaaagaagtcaggccactttgatgccatagcttgagcaactgtgcagcctgtagctccacctgagaaggtgtaaaaaatccgggaggccacaaaccatggaagctgtacgcatggcgtagtggactagcggttagaggagacccctcccttacagatcgcagcaacaatgggggcccaaggtgagatgaagctgtagtctcactggaaggactagaggttagaggagacccccccaaaacaaaaaacagcatattgacgctgggaaagaccagagatcctgctgtctcctcagcatcattccaggcacaggacgccagaaaatggaatggtgctgttgaatcaacaggttct

SEQ ID NO: 48 - DNA, 18 bp, Artificial Sequence
  synthetic
gattcttgtcgtttctcg

SEQ ID NO: 49 - DNA, 23 bp, Artificial Sequence
  synthetic
cacacacggatcacattgacacc

SEQ ID NO: 50 - DNA, 20 bp, Artificial Sequence
  synthetic
gtgctttaatttatatcaag

SEQ ID NO: 51 - DNA, 20 bp, Artificial Sequence
  synthetic
cttgatataaattaaagcac

SEQ ID NO: 52 - DNA, 56 bp, Artificial Sequence
  synthetic
ggttggtttaatggagtgctttaatttatatcaagcagccaatttcggagtgttcc

SEQ ID NO: 53 - DNA, 24 bp, Artificial Sequence
  synthetic
gctcccaccatttccaccatttgc

SEQ ID NO: 54 - DNA, 21 bp, Artificial Sequence
  synthetic
ctcaccacctcctcttttggg

SEQ ID NO: 55 - DNA, 21 bp, Artificial Sequence
  synthetic
cccaaaagaggaggtggtgag

SEQ ID NO: 56 - DNA, 50 bp, Artificial Sequence
  synthetic
gccaagggtcatggtctcaccacctcctcttttggggttttgcaatatcc

SEQ ID NO: 57 - DNA, 50 bp, Artificial Sequence
  synthetic
ggatattgcaaaaccccaaaagaggaggtggtgagaccatgacccttggc

SEQ ID NO: 58 - DNA, 20 bp, Artificial Sequence
  synthetic
caaaactccactgcgctggc

SEQ ID NO: 59 - DNA, 20 bp, Artificial Sequence
  synthetic
gccagcgcagtggagttttg

SEQ ID NO: 60 - DNA, 41 bp, Artificial Sequence
  synthetic
ggcacgtcccacaaaactccactgcgctggcttttgcctgc

SEQ ID NO: 61 - DNA, 41 bp, Artificial Sequence; identical to SEQ ID NO: 60
  synthetic

SEQ ID NO: 62 - DNA, 41 bp, Artificial Sequence
  synthetic
gcaggcaaaagccagcgcagtggagttttgtgggacgtgcc

SEQ ID NO: 63 - DNA, 20 bp, Artificial Sequence
  synthetic
ggtgacgggatggaaaatgg

SEQ ID NO: 64 - DNA, 22 bp, Artificial Sequence
  synthetic
ggcacttacccatgaagtgacc

SEQ ID NO: 65 - DNA, 31 bp, Artificial Sequence
  synthetic
gagcaaccgtactcagcatgcacgttcacgg

SEQ ID NO: 66 - DNA, 31 bp, Artificial Sequence
  synthetic
ccgtgaacgtgcatgctgagtacggttgctc

SEQ ID NO: 67 - DNA, 17 bp, Artificial Sequence
  synthetic
gcatggaccaactaccg

SEQ ID NO: 68 - DNA, 29 bp, Artificial Sequence
  synthetic
ggaaatctctgttgctcattccaagacag

SEQ ID NO: 69 - DNA, 29 bp, Artificial Sequence
  synthetic
ctgtcttggaatgagcaacagagatttcc

SEQ ID NO: 70 - DNA, 30 bp, Artificial Sequence
  synthetic
gcaacaacatgggccgtcactctctccaac

SEQ ID NO: 71 - DNA, 24 bp, Artificial Sequence
  synthetic
gcacactagtttgtgacataaggc

SEQ ID NO: 72 - DNA, 20 bp, Artificial Sequence
  synthetic
cgcttgttttggcacactag

SEQ ID NO: 73 - DNA, 16 bp, Artificial Sequence
  synthetic
gcgtacggattttacg

SEQ ID NO: 74 - DNA, 16 bp, Artificial Sequence
  synthetic
cgtaaaatccgtacgc

SEQ ID NO: 75 - DNA, 27 bp, Artificial Sequence
  synthetic
gtacggattttacggtttaccagatcg

SEQ ID NO: 76 - DNA, 27 bp, Artificial Sequence
  synthetic
cgatctggtaaaccgtaaaatccgtac

SEQ ID NO: 77 - DNA, 20 bp, Artificial Sequence
  synthetic
tggatggccttccccattat

SEQ ID NO: 78 - DNA, 25 bp, Artificial Sequence
  synthetic
cattataagctgcaataaacaagtt

SEQ ID NO: 79 - DNA, 19 bp, Artificial Sequence
  synthetic
gggtcggcatggcatctcc

SEQ ID NO: 80 - DNA, 30 bp, Artificial Sequence
  synthetic
tgccatgccgacccagatacttgatgtttc

SEQ ID NO: 81 - DNA, 30 bp, Artificial Sequence; identical to SEQ ID NO: 80
  synthetic

SEQ ID NO: 82 - DNA, 30 bp, Artificial Sequence
  synthetic
ggcaatgtgatctaaggatctacgaacgag

SEQ ID NO: 83 - DNA, 30 bp, Artificial Sequence
  synthetic
ctcgttcgtagatccttagatcacattgcc

SEQ ID NO: 84 - DNA, 30 bp, Artificial Sequence
  synthetic
ggagttcctaggaggggattacaggccacc

SEQ ID NO: 85 - DNA, 30 bp, Artificial Sequence
  synthetic
ggtggcctgtaatcccctcctaggaactcc

SEQ ID NO: 86 - DNA, 30 bp, Artificial Sequence
  synthetic
aaatcaaacaagcgggggactgtgttgtgg

SEQ ID NO: 87 - DNA, 30 bp, Artificial Sequence
  synthetic
ccacaacacagtcccccgcttgtttgattt

SEQ ID NO: 88 - DNA, 30 bp, Artificial Sequence
  synthetic
gtgaccgtgggtgccctatcggaaatagga

SEQ ID NO: 89 - DNA, 30 bp, Artificial Sequence
  synthetic
tcctatttccgatagggcacccacggtcac

SEQ ID NO: 90 - DNA, 30 bp, Artificial Sequence
  synthetic
gctccgtcatatggtaaccaatgcctggat

SEQ ID NO: 91 - DNA, 30 bp, Artificial Sequence
  synthetic
atccaggcattggttaccatatgacggagc

SEQ ID NO: 92 - DNA, 30 bp, Artificial Sequence
  synthetic
aacgatctggtaaacagtatattttgcgtg

SEQ ID NO: 93 - DNA, 30 bp, Artificial Sequence
  synthetic
cacgcaaaatatactgtttaccagatcgtt

SEQ ID NO: 94 - DNA, 20 bp, Artificial Sequence
  synthetic
tggatggccttccccattat

SEQ ID NO: 95 - DNA, 25 bp, Artificial Sequence
  synthetic
cattataagctgcaataaacaagtt

SEQ ID NO: 96 - DNA, 19 bp, Artificial Sequence
  synthetic
gggtcggcatggcatctcc

SEQ ID NO: 97 - DNA, 19 bp, Artificial Sequence
  synthetic
tcctgtgttctcgcaccac

SEQ ID NO: 98 - DNA, 19 bp, Artificial Sequence
  synthetic
gtggtgcgagaacacagga

SEQ ID NO: 99 - DNA, 26 bp, Artificial Sequence
  synthetic
ttacaatactgtatcctcaaccaatg

SEQ ID NO: 100 - DNA, 28 bp, Artificial Sequence
  synthetic
ctgtatcctcaaccaatgttgtgtcttc

SEQ ID NO: 101 - DNA, 28 bp, Artificial Sequence
  synthetic
gaagacacaacattggttgaggatacag

SEQ ID NO: 102 - DNA, 16 bp, Artificial Sequence
  synthetic
ggtggggcaaaaggac

SEQ ID NO: 103 - DNA, 19 bp, Artificial Sequence
  synthetic
cgtccttttgccccacctc

SEQ ID NO: 104 - DNA, 19 bp, Artificial Sequence
  synthetic
gaggtggggcaaaaggacg

SEQ ID NO: 105 - DNA, 20 bp, Artificial Sequence
  synthetic
cccatctcattggctgccac

SEQ ID NO: 106 - DNA, 20 bp, Artificial Sequence
  synthetic
gtggcagccaatgagatggg

SEQ ID NO: 107 - DNA, 20 bp, Artificial Sequence
  synthetic
tagctggttgtctgtctgcg

SEQ ID NO: 108 - DNA, 22 bp, Artificial Sequence
  synthetic
ttgagtgtgatgaccatgggag

SEQ ID NO: 109 - DNA, 28 bp, Artificial Sequence
  synthetic
gacctcgataaaacctatttgagagcgc

SEQ ID NO: 110 - DNA, 28 bp, Artificial Sequence
  synthetic
gcgctctcaaataggttttatcgaggtc

SEQ ID NO: 111 - DNA, 29 bp, Artificial Sequence
  synthetic
ctcctctctttgtgtattggagagttatc

SEQ ID NO: 112 - DNA, 29 bp, Artificial Sequence
  synthetic
gataactctccaatacacaaagagaggag

SEQ ID NO: 113 - DNA, 19 bp, Artificial Sequence
  synthetic
cttcagttgcaggccaccc

SEQ ID NO: 114 - DNA, 19 bp, Artificial Sequence
  synthetic
gggtggcctgcaactgaag

SEQ ID NO: 115 - DNA, 29 bp, Artificial Sequence
  synthetic
gaaaaggatcaatcatgtcagcgttgtag

SEQ ID NO: 116 - DNA, 29 bp, Artificial Sequence
  synthetic
ctacaacgctgacatgattgatccttttc

SEQ ID NO: 117 - DNA, 20 bp, Artificial Sequence
  synthetic
cggtccatccaagcttccac

SEQ ID NO: 118 - DNA, 30 bp, Artificial Sequence
  synthetic
ggcacatccagtatcagcgttaactccaag

SEQ ID NO: 119 - DNA, 30 bp, Artificial Sequence
  synthetic
cttggagttaacgctgatactggatgtgcc

SEQ ID NO: 120 - DNA, 60 bp, Artificial Sequence
  synthetic
ccgacttatatctatggcacatccagtatcagcgttaactccaagtgtcatgaacaacag

SEQ ID NO: 121 - DNA, 60 bp, Artificial Sequence
  synthetic
ctgttgttcatgacacttggagttaacgctgatactggatgtgccatagatataagtcgg

SEQ ID NO: 122 - DNA, 23 bp, Artificial Sequence
  synthetic
gataggtgtgaactcccgcaatg

SEQ ID NO: 123 - DNA, 25 bp, Artificial Sequence
  synthetic
cctgcttacggctctcactgcattg

SEQ ID NO: 124 - DNA, 20 bp, Artificial Sequence
  synthetic
ggcaattggacctgcttacg

SEQ ID NO: 125 - DNA, 25 bp, Artificial Sequence
  synthetic
gcaatcaatgtcgtcaggctcttcc

SEQ ID NO: 126 - DNA, 24 bp, Artificial Sequence
  synthetic
caccagtatccagcatcattgatg

SEQ ID NO: 127 - DNA, 29 bp, Artificial Sequence
  synthetic
cttcctgagagttaatgctcccacgccag

SEQ ID NO: 128 - DNA, 29 bp, Artificial Sequence
  synthetic
ctggcgtgggagcattaactctcaggaag

SEQ ID NO: 129 - DNA, 60 bp, Artificial Sequence
  synthetic
aatagtgttgtcaatcttcctgagagttaatgctcccacgccagcaatcaagccaatcat

SEQ ID NO: 130 - DNA, 60 bp, Artificial Sequence
  synthetic
atgattggcttgattgctggcgtgggagcattaactctcaggaagattgacaacactatt

SEQ ID NO: 131 - DNA, 24 bp, Artificial Sequence
  synthetic
cagaagaagagaggaggaaagacc

SEQ ID NO: 132 - DNA, 21 bp, Artificial Sequence
  synthetic
ggccctcctggtttcttagac

SEQ ID NO: 133 - DNA, 21 bp, Artificial Sequence
  synthetic
gtctaagaaaccaggagggcc

SEQ ID NO: 134 - DNA, 22 bp, Artificial Sequence
  synthetic
cagctcacacaggcgaactact

SEQ ID NO: 135 - DNA, 22 bp, Artificial Sequence
  synthetic
agtagttcgcctgtgtgagctg

SEQ ID NO: 136 - DNA, 20 bp, Artificial Sequence
  synthetic
tggatggccttccccattat

SEQ ID NO: 137 - DNA, 25 bp, Artificial Sequence
  synthetic
cattataagctgcaataaacaagtt

SEQ ID NO: 138 - DNA, 19 bp, Artificial Sequence
  synthetic
gggtcggcatggcatctcc

SEQ ID NO: 139 - DNA, 19 bp, Artificial Sequence
  synthetic
tcctgtgttctcgcaccac

SEQ ID NO: 140 - DNA, 19 bp, Artificial Sequence
  synthetic
gtggtgcgagaacacagga

SEQ ID NO: 141 - DNA, 26 bp, Artificial Sequence
  synthetic
ttacaatactgtatcctcaaccaatg

SEQ ID NO: 142 - DNA, 28 bp, Artificial Sequence
  synthetic
ctgtatcctcaaccaatgttgtgtcttc

SEQ ID NO: 143 - DNA, 28 bp, Artificial Sequence
  synthetic
gaagacacaacattggttgaggatacag

SEQ ID NO: 144 - DNA, 16 bp, Artificial Sequence
  synthetic
ggtggggcaaaaggac

SEQ ID NO: 145 - DNA, 19 bp, Artificial Sequence
  synthetic
cgtccttttgccccacctc

SEQ ID NO: 146 - DNA, 19 bp, Artificial Sequence
  synthetic
gaggtggggcaaaaggacg

SEQ ID NO: 147 - DNA, 20 bp, Artificial Sequence
  synthetic
cccatctcattggctgccac

SEQ ID NO: 148 - DNA, 20 bp, Artificial Sequence
  synthetic
gtggcagccaatgagatggg

SEQ ID NO: 149 - DNA, 20 bp, Artificial Sequence
  synthetic
tagctggttgtctgtctgcg

SEQ ID NO: 150 - DNA, 22 bp, Artificial Sequence
  synthetic
ttgagtgtgatgaccatgggag

SEQ ID NO: 151 - DNA, 28 bp, Artificial Sequence
  synthetic
gacctcgataaaacctatttgagagcgc

SEQ ID NO: 152 - DNA, 28 bp, Artificial Sequence
  synthetic
gcgctctcaaataggttttatcgaggtc

SEQ ID NO: 153 - DNA, 29 bp, Artificial Sequence
  synthetic
ctcctctctttgtgtattggagagttatc

SEQ ID NO: 154 - DNA, 29 bp, Artificial Sequence
  synthetic
gataactctccaatacacaaagagaggag

SEQ ID NO: 155 - DNA, 19 bp, Artificial Sequence
  synthetic
cttcagttgcaggccaccc

SEQ ID NO: 156 - DNA, 19 bp, Artificial Sequence
  synthetic
gggtggcctgcaactgaag

SEQ ID NO: 157 - DNA, 29 bp, Artificial Sequence
  synthetic
gaaaaggatcaatcatgtcagcgttgtag

SEQ ID NO: 158 - DNA, 29 bp, Artificial Sequence
  synthetic
ctacaacgctgacatgattgatccttttc

SEQ ID NO: 159 - DNA, 20 bp, Artificial Sequence
  synthetic
cggtccatccaagcttccac

SEQ ID NO: 160 - DNA, 30 bp, Artificial Sequence
  synthetic
ggcacatccagtatcggcacccacggtcac

SEQ ID NO: 161 - DNA, 30 bp, Artificial Sequence
  synthetic
gtgaccgtgggtgccgatactggatgtgcc

SEQ ID NO: 162 - DNA, 30 bp, Artificial Sequence; identical to SEQ ID NO: 91
  synthetic

SEQ ID NO: 163 - DNA, 30 bp, Artificial Sequence; identical to SEQ ID NO: 90
  synthetic

SEQ ID NO: 164 - DNA, 30 bp, Artificial Sequence
  synthetic
ggctatcgtgattgctgctcccacgccagc

SEQ ID NO: 165 - DNA, 30 bp, Artificial Sequence
  synthetic
gctggcgtgggagcagcaatcacgatagcc

SEQ ID NO: 166 - DNA, 24 bp, Artificial Sequence
  synthetic
cagaagaagagaggaggaaagacc

SEQ ID NO: 167 - DNA, 21 bp, Artificial Sequence
  synthetic
ggccctcctggtttcttagac

SEQ ID NO: 168 - DNA, 21 bp, Artificial Sequence
  synthetic
gtctaagaaaccaggagggcc

SEQ ID NO: 169 - DNA, 22 bp, Artificial Sequence
  synthetic
cagctcacacaggcgaactact

SEQ ID NO: 170 - DNA, 22 bp, Artificial Sequence
  synthetic
agtagttcgcctgtgtgagctg

SEQ ID NO: 171 - DNA, 20 bp, Artificial Sequence
  synthetic
tggatggccttccccattat

SEQ ID NO: 172 - DNA, 25 bp, Artificial Sequence
  synthetic
cattataagctgcaataaacaagtt

SEQ ID NO: 173 - DNA, 19 bp, Artificial Sequence
  synthetic
gggtcggcatggcatctcc

SEQ ID NO: 174 - DNA, 19 bp, Artificial Sequence
  synthetic
tcctgtgttctcgcaccac

SEQ ID NO: 175 - DNA, 19 bp, Artificial Sequence
  synthetic
gtggtgcgagaacacagga

SEQ ID NO: 176 - DNA, 26 bp, Artificial Sequence
  synthetic
ttacaatactgtatcctcaaccaatg

SEQ ID NO: 177 - DNA, 28 bp, Artificial Sequence
  synthetic
ctgtatcctcaaccaatgttgtgtcttc

SEQ ID NO: 178 - DNA, 28 bp, Artificial Sequence
  synthetic
gaagacacaacattggttgaggatacag

SEQ ID NO: 179 - DNA, 16 bp, Artificial Sequence
  synthetic
ggtggggcaaaaggac

SEQ ID NO: 180 - DNA, 19 bp, Artificial Sequence
  synthetic
cgtccttttgccccacctc

SEQ ID NO: 181 - DNA, 19 bp, Artificial Sequence
  synthetic
gaggtggggcaaaaggacg

SEQ ID NO: 182 - DNA, 20 bp, Artificial Sequence
  synthetic
cccatctcattggctgccac

SEQ ID NO: 183 - DNA, 20 bp, Artificial Sequence
  synthetic
gtggcagccaatgagatggg

SEQ ID NO: 184 - DNA, 20 bp, Artificial Sequence
  synthetic
tagctggttgtctgtctgcg

SEQ ID NO: 185 - DNA, 22 bp, Artificial Sequence
  synthetic
ttgagtgtgatgaccatgggag

SEQ ID NO: 186 - DNA, 28 bp, Artificial Sequence
  synthetic
gacctcgataaaacctatttgagagcgc

SEQ ID NO: 187 - DNA, 28 bp, Artificial Sequence
  synthetic
gcgctctcaaataggttttatcgaggtc

SEQ ID NO: 188 - DNA, 29 bp, Artificial Sequence
  synthetic
ctcctctctttgtgtattggagagttatc

SEQ ID NO: 189 - DNA, 29 bp, Artificial Sequence
  synthetic
gataactctccaatacacaaagagaggag

SEQ ID NO: 190 - DNA, 19 bp, Artificial Sequence
  synthetic
cttcagttgcaggccaccc

SEQ ID NO: 191 - DNA, 19 bp, Artificial Sequence
  synthetic
gggtggcctgcaactgaag

SEQ ID NO: 192 - DNA, 29 bp, Artificial Sequence
  synthetic
gaaaaggatcaatcatgtcagcgttgtag

SEQ ID NO: 193 - DNA, 29 bp, Artificial Sequence
  synthetic
ctacaacgctgacatgattgatccttttc

SEQ ID NO: 194 - DNA, 20 bp, Artificial Sequence
  synthetic
cggtccatccaagcttccac

SEQ ID NO: 195 - DNA, 30 bp, Artificial Sequence
  synthetic
ggcacatccagtatcagcccgcacatagta

SEQ ID NO: 196 - DNA, 30 bp, Artificial Sequence
  synthetic
tactatgtgcgggctgatactggatgtgcc

SEQ ID NO: 197 - DNA, 30 bp, Artificial Sequence
  synthetic
aaactccccctttactgtggtccaagtgcc

SEQ ID NO: 198 - DNA, 30 bp, Artificial Sequence
  synthetic
ggcacttggaccacagtaaagggggagttt

SEQ ID NO: 199 - DNA, 30 bp, Artificial Sequence
  synthetic
catgtcaatcaccactgctcccacgccagc

SEQ ID NO: 200 - DNA, 30 bp, Artificial Sequence
  synthetic
gctggcgtgggagcagtggtgattgacatg

SEQ ID NO: 201 - DNA, 24 bp, Artificial Sequence
  synthetic
cagaagaagagaggaggaaagacc

SEQ ID NO: 202 - DNA, 21 bp, Artificial Sequence
  synthetic
ggccctcctggtttcttagac

SEQ ID NO: 203 - DNA, 21 bp, Artificial Sequence
  synthetic
gtctaagaaaccaggagggcc

SEQ ID NO: 204 - DNA, 22 bp, Artificial Sequence
  synthetic
cagctcacacaggcgaactact

SEQ ID NO: 205 - DNA, 22 bp, Artificial Sequence
  synthetic
agtagttcgcctgtgtgagctg

SEQ ID NO: 206 - DNA, 20 bp, Artificial Sequence
  synthetic
tggatggccttccccattat

SEQ ID NO: 207 - DNA, 25 bp, Artificial Sequence
  synthetic
cattataagctgcaataaacaagtt

SEQ ID NO: 208 - DNA, 19 bp, Artificial Sequence
  synthetic
gggtcggcatggcatctcc

SEQ ID NO: 209 - DNA, 19 bp, Artificial Sequence
  synthetic
tcctgtgttctcgcaccac

SEQ ID NO: 210 - DNA, 19 bp, Artificial Sequence
  synthetic
gtggtgcgagaacacagga

SEQ ID NO: 211 - DNA, 26 bp, Artificial Sequence
  synthetic
ttacaatactgtatcctcaaccaatg

SEQ ID NO: 212 - DNA, 28 bp, Artificial Sequence
  synthetic
ctgtatcctcaaccaatgttgtgtcttc

SEQ ID NO: 213 - DNA, 28 bp, Artificial Sequence
  synthetic
gaagacacaacattggttgaggatacag

SEQ ID NO: 214 - DNA, 16 bp, Artificial Sequence
  synthetic
ggtggggcaaaaggac

SEQ ID NO: 215 - DNA, 19 bp, Artificial Sequence
  synthetic
cgtccttttgccccacctc

SEQ ID NO: 216 - DNA, 19 bp, Artificial Sequence
  synthetic
gaggtggggcaaaaggacg

SEQ ID NO: 217 - DNA, 20 bp, Artificial Sequence
  synthetic
cccatctcattggctgccac

SEQ ID NO: 218 - DNA, 20 bp, Artificial Sequence
  synthetic
gtggcagccaatgagatggg

SEQ ID NO: 219 - DNA, 20 bp, Artificial Sequence
  synthetic
tagctggttgtctgtctgcg

SEQ ID NO: 220 - DNA, 22 bp, Artificial Sequence
  synthetic
ttgagtgtgatgaccatgggag

SEQ ID NO: 221 - DNA, 28 bp, Artificial Sequence
  synthetic
gacctcgataaaacctatttgagagcgc

SEQ ID NO: 222 - DNA, 28 bp, Artificial Sequence
  synthetic
gcgctctcaaataggttttatcgaggtc

SEQ ID NO: 223 - DNA, 29 bp, Artificial Sequence
  synthetic
ctcctctctttgtgtattggagagttatc

SEQ ID NO: 224 - DNA, 29 bp, Artificial Sequence
  synthetic
gataactctccaatacacaaagagaggag

SEQ ID NO: 225 - DNA, 19 bp, Artificial Sequence
  synthetic
cttcagttgcaggccaccc

SEQ ID NO: 226 - DNA, 19 bp, Artificial Sequence
  synthetic
gggtggcctgcaactgaag

SEQ ID NO: 227 - DNA, 29 bp, Artificial Sequence
  synthetic
gaaaaggatcaatcatgtcagcgttgtag

SEQ ID NO: 228 - DNA, 29 bp, Artificial Sequence
  synthetic
ctacaacgctgacatgattgatccttttc

SEQ ID NO: 229 - DNA, 20 bp, Artificial Sequence
  synthetic
cggtccatccaagcttccac

SEQ ID NO: 230 - DNA, 30 bp, Artificial Sequence
  synthetic
ggcacatccagtatcagctcgcacgtatgt

SEQ ID NO: 231 - DNA, 30 bp, Artificial Sequence
  synthetic
acatacgtgcgagctgatactggatgtgcc

SEQ ID NO: 232 - DNA, 30 bp, Artificial Sequence
  synthetic
tccattcatggtctttgctcccacgccagc

SEQ ID NO: 233 - DNA, 30 bp, Artificial Sequence
  synthetic
gctggcgtgggagcaaagaccatgaatgga

SEQ ID NO: 234 - DNA, 24 bp, Artificial Sequence
  synthetic
cagaagaagagaggaggaaagacc

SEQ ID NO: 235 - DNA, 21 bp, Artificial Sequence
  synthetic
ggccctcctggtttcttagac

SEQ ID NO: 236 - DNA, 21 bp, Artificial Sequence
  synthetic
gtctaagaaaccaggagggcc

SEQ ID NO: 237 - DNA, 22 bp, Artificial Sequence
  synthetic
cagctcacacaggcgaactact

SEQ ID NO: 238 - DNA, 22 bp, Artificial Sequence
  synthetic
agtagttcgcctgtgtgagctg

SEQ ID NO: 239 - DNA, 20 bp, Artificial Sequence
  synthetic
tggatggccttccccattat

SEQ ID NO: 240 - DNA, 25 bp, Artificial Sequence
  synthetic
cattataagctgcaataaacaagtt

SEQ ID NO: 241 - DNA, 19 bp, Artificial Sequence
  synthetic
gggtcggcatggcatctcc

SEQ ID NO: 242 - DNA, 19 bp, Artificial Sequence
  synthetic
tcctgtgttctcgcaccac

SEQ ID NO: 243 - DNA, 19 bp, Artificial Sequence
  synthetic
gtggtgcgagaacacagga

SEQ ID NO: 244 - DNA, 26 bp, Artificial Sequence
  synthetic
ttacaatactgtatcctcaaccaatg

SEQ ID NO: 245 - DNA, 28 bp, Artificial Sequence
  synthetic
ctgtatcctcaaccaatgttgtgtcttc

SEQ ID NO: 246 - DNA, 28 bp, Artificial Sequence
  synthetic
gaagacacaacattggttgaggatacag

SEQ ID NO: 247 - DNA, 16 bp, Artificial Sequence
  synthetic
ggtggggcaaaaggac

SEQ ID NO: 248 - DNA, 19 bp, Artificial Sequence
  synthetic
cgtccttttgccccacctc

SEQ ID NO: 249 - DNA, 19 bp, Artificial Sequence
  synthetic
gaggtggggcaaaaggacg

SEQ ID NO: 250 - DNA, 20 bp, Artificial Sequence
  synthetic
cccatctcattggctgccac

SEQ ID NO: 251 - DNA, 20 bp, Artificial Sequence
  synthetic
gtggcagccaatgagatggg

SEQ ID NO: 252 - DNA, 20 bp, Artificial Sequence
  synthetic
tagctggttgtctgtctgcg

SEQ ID NO: 253 - DNA, 22 bp, Artificial Sequence
  synthetic
ttgagtgtgatgaccatgggag

SEQ ID NO: 254 - DNA, 28 bp, Artificial Sequence
  synthetic
gacctcgataaaacctatttgagagcgc

SEQ ID NO: 255 - DNA, 28 bp, Artificial Sequence
  synthetic
gcgctctcaaataggttttatcgaggtc

SEQ ID NO: 256 - DNA, 29 bp, Artificial Sequence
  synthetic
ctcctctctttgtgtattggagagttatc

SEQ ID NO: 257 - DNA, 29 bp, Artificial Sequence
  synthetic
gataactctccaatacacaaagagaggag

SEQ ID NO: 258 - DNA, 19 bp, Artificial Sequence
  synthetic
cttcagttgcaggccaccc

SEQ ID NO: 259 - DNA, 19 bp, Artificial Sequence
  synthetic
gggtggcctgcaactgaag

SEQ ID NO: 260 - DNA, 29 bp, Artificial Sequence
  synthetic
gaaaaggatcaatcatgtcagcgttgtag

SEQ ID NO: 261 - DNA, 29 bp, Artificial Sequence
  synthetic
ctacaacgctgacatgattgatccttttc

SEQ ID NO: 262 - DNA, 20 bp, Artificial Sequence
  synthetic
cggtccatccaagcttccac

SEQ ID NO: 263 - DNA, 27 bp, Artificial Sequence
  synthetic
cacatccagtatcagctcgggtataag

SEQ ID NO: 264 - DNA, 27 bp, Artificial Sequence
  synthetic
cttatacccgagctgatactggatgtg

SEQ ID NO: 265 - DNA, 60 bp, Artificial Sequence
  synthetic
ccgacttatatctatggcacatccagtatcagctcgggtataagcgattccacagaggat

SEQ ID NO: 266 - DNA, 60 bp, Artificial Sequence
  synthetic
atcctctgtggaatcgcttatacccgagctgatactggatgtgccatagatataagtcgg

SEQ ID NO: 267 - DNA, 20 bp, Artificial Sequence
  synthetic
aaacatccggttccccatcc

SEQ ID NO: 268 - DNA, 20 bp, Artificial Sequence
  synthetic
attcgaccgacatatgcccc

SEQ ID NO: 269 - DNA, 25 bp, Artificial Sequence
  synthetic
ccaagaatggctcaacaaactcacc

SEQ ID NO: 270 - DNA, 25 bp, Artificial Sequence
  synthetic
ggtgagtttgttgagccattcttgg

SEQ ID NO: 271 - DNA, 20 bp, Artificial Sequence
  synthetic
ggattgtcactgctcccacg

SEQ ID NO: 272 - DNA, 20 bp, Artificial Sequence
  synthetic
cgtgggagcagtgacaatcc

SEQ ID NO: 273 - DNA, 60 bp, Artificial Sequence
  synthetic
atcagtagtgacaaccacttggattgtcactgctcccacgccagcaatcaagccaatcat

SEQ ID NO: 274 - DNA, 60 bp, Artificial Sequence
  synthetic
atgattggcttgattgctggcgtgggagcagtgacaatccaagtggttgtcactactgat

SEQ ID NO: 275 - DNA, 24 bp, Artificial Sequence
  synthetic
cagaagaagagaggaggaaagacc

SEQ ID NO: 276 - DNA, 21 bp, Artificial Sequence
  synthetic
ggccctcctggtttcttagac

SEQ ID NO: 277 - DNA, 21 bp, Artificial Sequence
  synthetic
gtctaagaaaccaggagggcc

SEQ ID NO: 278 - DNA, 22 bp, Artificial Sequence
  synthetic
cagctcacacaggcgaactact

SEQ ID NO: 279 - DNA, 22 bp, Artificial Sequence
  synthetic
agtagttcgcctgtgtgagctg

SEQ ID NO: 280 - DNA, 20 bp, Artificial Sequence
  synthetic
tggatggccttccccattat

SEQ ID NO: 281 - DNA, 25 bp, Artificial Sequence
  synthetic
cattataagctgcaataaacaagtt

SEQ ID NO: 282 - DNA, 19 bp, Artificial Sequence
  synthetic
gggtcggcatggcatctcc

SEQ ID NO: 283 - DNA, 19 bp, Artificial Sequence
  synthetic
tcctgtgttctcgcaccac

SEQ ID NO: 284 - DNA, 19 bp, Artificial Sequence
  synthetic
gtggtgcgagaacacagga

SEQ ID NO: 285 - DNA, 26 bp, Artificial Sequence
  synthetic
ttacaatactgtatcctcaaccaatg

SEQ ID NO: 286 - DNA, 28 bp, Artificial Sequence
  synthetic
ctgtatcctcaaccaatgttgtgtcttc

SEQ ID NO: 287 - DNA, 28 bp, Artificial Sequence
  synthetic
gaagacacaacattggttgaggatacag

SEQ ID NO: 288 - DNA, 16 bp, Artificial Sequence
  synthetic
ggtggggcaaaaggac

SEQ ID NO: 289 - DNA, 19 bp, Artificial Sequence
  synthetic
cgtccttttgccccacctc

SEQ ID NO: 290 - DNA, 19 bp, Artificial Sequence
  synthetic
gaggtggggcaaaaggacg

SEQ ID NO: 291 - DNA, 20 bp, Artificial Sequence
  synthetic
cccatctcattggctgccac

SEQ ID NO: 292 - DNA, 20 bp, Artificial Sequence
  synthetic
gtggcagccaatgagatggg

SEQ ID NO: 293 - DNA, 20 bp, Artificial Sequence
  synthetic
tagctggttgtctgtctgcg

SEQ ID NO: 294 - DNA, 22 bp, Artificial Sequence
  synthetic
ttgagtgtgatgaccatgggag

SEQ ID NO: 295 - DNA, 28 bp, Artificial Sequence
  synthetic
gacctcgataaaacctatttgagagcgc

SEQ ID NO: 296 - DNA, 28 bp, Artificial Sequence
  synthetic
gcgctctcaaataggttttatcgaggtc

SEQ ID NO: 297 - DNA, 29 bp, Artificial Sequence
  synthetic
ctcctctctttgtgtattggagagttatc

SEQ ID NO: 298 - DNA, 29 bp, Artificial Sequence
  synthetic
gataactctccaatacacaaagagaggag

SEQ ID NO: 299 - DNA, 19 bp, Artificial Sequence
  synthetic
cttcagttgcaggccaccc

SEQ ID NO: 300 - DNA, 19 bp, Artificial Sequence
  synthetic
gggtggcctgcaactgaag

SEQ ID NO: 301 - DNA, 29 bp, Artificial Sequence
  synthetic
gaaaaggatcaatcatgtcagcgttgtag

SEQ ID NO: 302 - DNA, 29 bp, Artificial Sequence
  synthetic
ctacaacgctgacatgattgatccttttc

SEQ ID NO: 303 - DNA, 20 bp, Artificial Sequence
  synthetic
cggtccatccaagcttccac

SEQ ID NO: 304 - DNA, 30 bp, Artificial Sequence
  synthetic
ggcacatccagtatcggctcgcacaaaata

SEQ ID NO: 305 - DNA, 30 bp, Artificial Sequence
  synthetic
tattttgtgcgagccgatactggatgtgcc

SEQ ID NO: 306 - DNA, 30 bp, Artificial Sequence
  synthetic
cggttccatgtattctcctcgaaccgttgt

SEQ ID NO: 307 - DNA, 30 bp, Artificial Sequence
  synthetic
acaacggttcgaggagaatacatggaaccg

SEQ ID NO: 308 - DNA, 30 bp, Artificial Sequence
  synthetic
gtcaatcaccacaactgctcccacgccagc

SEQ ID NO: 309 - DNA, 30 bp, Artificial Sequence
  synthetic
gctggcgtgggagcagttgtggtgattgac

SEQ ID NO: 310 - DNA, 24 bp, Artificial Sequence
  synthetic
cagaagaagagaggaggaaagacc

SEQ ID NO: 311 - DNA, 21 bp, Artificial Sequence
  synthetic
ggccctcctggtttcttagac

SEQ ID NO: 312 - DNA, 21 bp, Artificial Sequence
  synthetic
gtctaagaaaccaggagggcc

SEQ ID NO: 313 - DNA, 22 bp, Artificial Sequence
  synthetic
cagctcacacaggcgaactact

SEQ ID NO: 314 - DNA, 22 bp, Artificial Sequence
  synthetic
agtagttcgcctgtgtgagctg

SEQ ID NO: 315 - DNA, 20 bp, Artificial Sequence
  synthetic
tggatggccttccccattat

SEQ ID NO: 316 - DNA, 25 bp, Artificial Sequence
  synthetic
cattataagctgcaataaacaagtt

SEQ ID NO: 317 - DNA, 19 bp, Artificial Sequence
  synthetic
gggtcggcatggcatctcc

SEQ ID NO: 318 - DNA, 30 bp, Artificial Sequence
  synthetic
atgccatgccgacccagacgtagccaagta

SEQ ID NO: 319 - DNA, 30 bp, Artificial Sequence
  synthetic
tacttggctacgtctgggtcggcatggcat

SEQ ID NO: 320 - DNA, 30 bp, Artificial Sequence
  synthetic
catcgtcacacttcagttgaacacaggatc

SEQ ID NO: 321 - DNA, 30 bp, Artificial Sequence
  synthetic
gatcctgtgttcaactgaagtgtgacgatg

SEQ ID NO: 322 - DNA, 24 bp, Artificial Sequence
  synthetic
ccgtatttacccaaaggagtggac

SEQ ID NO: 323 - DNA, 30 bp, Artificial Sequence
  synthetic
actcttcaccagcgagcgcacgcccaatct

SEQ ID NO: 324 - DNA, 30 bp, Artificial Sequence
  synthetic
agattgggcgtgcgctcgctggtgaagagt

SEQ ID NO: 325 - DNA, 30 bp, Artificial Sequence
  synthetic
tagctccgaatttgcccgctgggacatagc

SEQ ID NO: 326 - DNA, 30 bp, Artificial Sequence
  synthetic
gctatgtcccagcgggcaaattcggagcta

SEQ ID NO: 327 - DNA, 30 bp, Artificial Sequence
  synthetic
tccacatccgaagtcggcctgcaccataac

SEQ ID NO: 328 - DNA, 30 bp, Artificial Sequence
  synthetic
gttatggtgcaggccgacttcggatgtgga

SEQ ID NO: 329 - DNA, 20 bp, Artificial Sequence
  synthetic
tgcagcgcattgtcattgaa

SEQ ID NO: 330 - DNA, 20 bp, Artificial Sequence
  synthetic
ttcaatgacaatgcgctgca

SEQ ID NO: 331 - DNA, 30 bp, Artificial Sequence
  synthetic
tgtggtcagatgaaatcccataactccgaa

SEQ ID NO: 332 - DNA, 30 bp, Artificial Sequence
  synthetic
ttcggagttatgggatttcatctgaccaca

SEQ ID NO: 333 - DNA, 20 bp, Artificial Sequence
  synthetic
ctcgcttttcctccttgctg

SEQ ID NO: 334 - DNA, 36 bp, Artificial Sequence
  synthetic
gcaaaagttttttaaaactgtttaccagatcgttgc

SEQ ID NO: 335 - DNA, 36 bp, Artificial Sequence
  synthetic
gcaacgatctggtaaacagttttaaaaaacttttgc

SEQ ID NO: 336 - DNA, 20 bp, Artificial Sequence
  synthetic
tggatggccttccccattat

SEQ ID NO: 337 - DNA, 25 bp, Artificial Sequence
  synthetic
cattataagctgcaataaacaagtt

SEQ ID NO: 338 - DNA, 19 bp, Artificial Sequence
  synthetic
gggtcggcatggcatctcc

SEQ ID NO: 339 - DNA, 30 bp, Artificial Sequence; identical to SEQ ID NO: 318
  synthetic

SEQ ID NO: 340 - DNA, 30 bp, Artificial Sequence; identical to SEQ ID NO: 319
  synthetic

SEQ ID NO: 341 - DNA, 30 bp, Artificial Sequence; identical to SEQ ID NO: 320
  synthetic

SEQ ID NO: 342 - DNA, 30 bp, Artificial Sequence; identical to SEQ ID NO: 321
  synthetic

SEQ ID NO: 343 - DNA, 24 bp, Artificial Sequence
  synthetic
ccgtatttacccaaaggagtggac

SEQ ID NO: 344 - DNA, 30 bp, Artificial Sequence; identical to SEQ ID NO: 323
  synthetic

SEQ ID NO: 345 - DNA, 30 bp, Artificial Sequence; identical to SEQ ID NO: 324
  synthetic

SEQ ID NO: 346 - DNA, 30 bp, Artificial Sequence; identical to SEQ ID NO: 325
  synthetic

SEQ ID NO: 347 - DNA, 30 bp, Artificial Sequence; identical to SEQ ID NO: 326
  synthetic

SEQ ID NO: 348 - DNA, 30 bp, Artificial Sequence
  synthetic
tccacatccgaagtcagcatgcacgttcac

SEQ ID NO: 349 - DNA, 30 bp, Artificial Sequence
  synthetic
gtgaacgtgcatgctgacttcggatgtgga

SEQ ID NO: 350 - DNA, 17 bp, Artificial Sequence
  synthetic
gcatggaccaactaccg

SEQ ID NO: 351 - DNA, 29 bp, Artificial Sequence
  synthetic
ggaaatctctgttgctcattccaagacag

SEQ ID NO: 352 - DNA, 29 bp, Artificial Sequence
  synthetic
ctgtcttggaatgagcaacagagatttcc

SEQ ID NO: 353 - DNA, 30 bp, Artificial Sequence
  synthetic
gttggagagagtgactcccataactccgaa

SEQ ID NO: 354 - DNA, 30 bp, Artificial Sequence
  synthetic
ttcggagttatgggagtcactctctccaac

SEQ ID NO: 355 - DNA, 20 bp, Artificial Sequence
  synthetic
ctcgcttttcctccttgctg

SEQ ID NO: 356 - DNA, 36 bp, Artificial Sequence; identical to SEQ ID NO: 334
  synthetic

SEQ ID NO: 357 - DNA, 36 bp, Artificial Sequence; identical to SEQ ID NO: 335
  synthetic

SEQ ID NO: 358 - DNA, 20 bp, Artificial Sequence
  synthetic
tggatggccttccccattat

SEQ ID NO: 359 - DNA, 25 bp, Artificial Sequence
  synthetic
cattataagctgcaataaacaagtt

SEQ ID NO: 360 - DNA, 19 bp, Artificial Sequence
  synthetic
gggtcggcatggcatctcc

SEQ ID NO: 361 - DNA, 30 bp, Artificial Sequence; identical to SEQ ID NO: 318
  synthetic

SEQ ID NO: 362 - DNA, 30 bp, Artificial Sequence; identical to SEQ ID NO: 319
  synthetic

SEQ ID NO: 363 - DNA, 30 bp, Artificial Sequence; identical to SEQ ID NO: 320
  synthetic

SEQ ID NO: 364 - DNA, 30 bp, Artificial Sequence; identical to SEQ ID NO: 321
  synthetic

SEQ ID NO: 365 - DNA, 24 bp, Artificial Sequence
  synthetic
ccgtatttacccaaaggagtggac

SEQ ID NO: 366 - DNA, 30 bp, Artificial Sequence; identical to SEQ ID NO: 323
  synthetic

SEQ ID NO: 367 - DNA, 30 bp, Artificial Sequence; identical to SEQ ID NO: 324
  synthetic

SEQ ID NO: 368 - DNA, 30 bp, Artificial Sequence; identical to SEQ ID NO: 325
  synthetic

SEQ ID NO: 369 - DNA, 30 bp, Artificial Sequence; identical to SEQ ID NO: 326
  synthetic

SEQ ID NO: 370 - DNA, 30 bp, Artificial Sequence
  synthetic
tccacatccgaagtcagcagagacggctgt

SEQ ID NO: 371 - DNA, 30 bp, Artificial Sequence
  synthetic
acagccgtctctgctgacttcggatgtgga

SEQ ID NO: 372 - DNA, 20 bp, Artificial Sequence
  synthetic
tgcacctgatgctgtatgcc

SEQ ID NO: 373 - DNA, 20 bp, Artificial Sequence
  synthetic
ggcatacagcatcaggtgca

SEQ ID NO: 374 - DNA, 30 bp, Artificial Sequence
  synthetic
tctagtgacctccgctcccataactccgaa

SEQ ID NO: 375 - DNA, 30 bp, Artificial Sequence
  synthetic
ttcggagttatgggagcggaggtcactaga

SEQ ID NO: 376 - DNA, 20 bp, Artificial Sequence
  synthetic
ctcgcttttcctccttgctg

SEQ ID NO: 377 - DNA, 36 bp, Artificial Sequence; identical to SEQ ID NO: 334
  synthetic

SEQ ID NO: 378 - DNA, 36 bp, Artificial Sequence; identical to SEQ ID NO: 335
  synthetic

SEQ ID NO: 379 - DNA, 20 bp, Artificial Sequence
  synthetic
tggatggccttccccattat

SEQ ID NO: 380 - DNA, 25 bp, Artificial Sequence
  synthetic
cattataagctgcaataaacaagtt

SEQ ID NO: 381 - DNA, 19 bp, Artificial Sequence
  synthetic
gggtcggcatggcatctcc

SEQ ID NO: 382 - DNA, 122 bp, Autographa californica nucleopolyhedrovirus
gtcgagtgattgtaaataaaatgtaatttacagtatagtattttaattaatatacaaatgatttgataataattcttatttaactataatatattgtgttgggttgaattaaaggtccgtat

SEQ ID NO: 383 - DNA, 129 bp, Autographa californica nucleopolyhedrovirus
atcatggagataattaaaatgataaccatctcgcaaataaataagtattttactgttttcgtaacagttttgtaataaaaaaacctataaatattccggattattcataccgtcccaccatcgggcgcg

SEQ ID NO: 384 - protein, 3474 aa, Artificial Sequence
  synthetic
MSGLGGLLPLRGKKKKAPVIQSQGRVLPKSDWKGAPKQDLNKKKAKKDETKGQNWPRRINPRTGQWSAIEGSGARLWRSIFSTDLIGGLLLLIAILSNLYEKVRRDITELKRRVTRLEKSRASLILTPMVLLCLAILAAGVTLSNFQGKVMMTVNATDVTDIITIPTAAGKNLCIVRAMDVGHMCDDTITYECPVLSAGNDPEDIDCWCTKLAVYVRYGRCTKTRHSRRSRRSLTVQTHGESTLSNKKGAWMDSTKATRYLVKTESWILRNPGYALVAAVIGWMLGSNTMQRVVFAVLLLLVAPAYSFNCLGMSNRDFLEGVSGATWVDLVLEGDSCVTIMSKDKPTIDVKMMNMEAANLAEVRSYCYLATVSELSTKAACPTMGEAHNDKRADPSFVCKQGVVDRGWGNGCGLFGKGSIDTCAKFACSTKATGRTILKENIKYEVAIFVHGPTTVESHGNYFTQTGAAQAGRFSITPAAPSYTLKLGEYGEVTVDCEPRSGIDTSAYYVMTVGTKTFLVHREWFMDLNLPWSSAESNVWRNRETLMEFEEPHATKQSVIALGSQEGALHQALAGAIPVEFSSNTVKLTSGHLKCRVKMEKLQLKGTTYGVCSKAFRFLGTPADTGHGTVVLELQYTGTDGPCKIPISSVASLNDLTPVGRLVTVNPFVSVSTANAKVLIELEPPFGDSYIVVGRGEQQINHHWHKSGSSIGKAFTATLKGAQRLAALGDTAWDFGSVGGVFTSVGKAVHQVFGGAFRSLFGGMSWITQGLLGALLLWMGINARDRSIALTFLAVGGVLLFLSVNVHADIGCGIDFDRKTYTCGSGLFVWKGLGKYPTADHSVEFASYDFLSAYLQEQFKSEKKVCIICEDIVQCEAARKAAAAVYKNLGHPFVYVNTSDSYGKVFAEIPKRVHTVSVGVDVVEMAMMTRENKPVGPFGDLPRSMVSWKSIPETEEHPVLRVLTSSSDYQKVCGKAIGFQYDFVGYRRTMYGSNVQLKISKKVSIECPTYLAGVAVKNDRTVFTDGMFWMSSKRENGTYAITELEMEQSHKCIWPDQYTPDATLTPRDNEMFVPPEWGGPMSKANHIPGYKMQTGFPWNKAPIRFVEGSVPGTIVTQISHCDGRGIAAEVNPATQPNWCCKSCTRIFHFEVDGKLYYPMEIRPDPKGGEQQKVPVVETPIGDEETETVGGWLGRMYNIPGAEGSYADFRLPKLPNSRPSAMVGSLVNLLCLMFSIQIVTKTMRARTLMRFYLCCLVFMFFGMPTLFGLSGFLAWMMILPISHNSVTMCNLTVHLWAVLLNQSSAMFLWGLTLRSQIQRSTAGQMLLFTMQMLHHAIYAHSWVFGWVIEVCLSVGLMMNLLTVIDTVHPKLIAYLLFFGWKTGMCVVCAWLLIYSIRRWNSIVAAAPAAGGWRSGYRTMMSSSLIVIFISVGIAGVIASDYGGYPAAAAVTAALLIMGIKMFDFLTTRLSLEFVSAGMFPEGVEKAFEPDSVSDLFRASFTVDGIKLQDHVEPIPILFAILYIFIGAVACKVNPALGIVYAIAMFATPLPELMRLYMMTIYSSTFRTDTLLGMAIPETEPELSQDFGPIPDGIYRVNNHGFSVKSHRGVGIVKNGVFHTLMHVTLNEPLAWQNRLVGPSMGHSLKDYVTYGGNWQLPDFDIVNEVGIMVCGRDRSIQYKRHEVGTIMIDDKRVMYFTHDYGHGSSGSPIFVNGEPVALYGFGFHLYNRYRSIVLPIPREEVLDGASNEGIPAEHGTMRNKFFVDWHPGKGKTRKVIVKEVLNALNLARRIVVLAPTRVVLAEITKAIGENTSKTPSKNLAFTGHNIVTVACHATFTDYVLRHGLSKFKAHEVIMDECHFLDPRSIAARGILEHLATKRGVKVTFMSATIPGREPSLGSNFEISEQALQFPRDVNQRWIETVARGKTVAFVPSHRVGDKLARGCPQAISLHRNNFDTNYSTAMDESIKFIYTTDISEMGANFSADTVIDFRVAIKPKISSEFAVTLEPTPITRSSMIQRRGRVGRQRPGTYIYPVDKGVEDASDQLACWTEAQMLLDQLDLTMMAEEVRQSNIPGAYKLVGRSLDIFRKLLEKDDIPIWLSWKWADSVQQQYSILFEGERQENVARVVNTRDYASLEYKPKFVDARFERLGWDQRKLSIQFYMNTRSFITFATLSHVISQVIEAGVVNSAWKRIGDVSIIFTEGGDPHAKDETIMAWTILVGGVLGALGFLIVAWGMKAVLRVIFGSRDKHLSVPTLVADFQPYIVCIVPIALHLAGVPIPMTIVFFAMLFLTYPLMYKSAGQRSYVDIDLVKWILLGGCIVTGVICWEMRLLPNISSDISAILNRQRQREDTPTFDASPPWEWLDLAQPVPHNVELTSVVITTFTTWLFLHQIVGWSYESEWLKSYFDHKGVGQIMGGFRLDTISWGSALSGLLGTATYASWGAILTGLGGAVVYFFLMVSMLKWNFSGGATTGLENNVMRNDRETGLGNRPANDNRRSLLYGVVAAECLVWLFCFRTATDAIVVACLVSYCLWIINNPASPHHKNTDLGSACSFIGLLYCTCPTQKCIQVLMRFALARLNMNTRSLEKSATGGLGHRWKKLLNAMTLLEFNAYRSCGVDETEKGDYVSRGGLKLREITMKYGWKPEGICVDLGCGRGGWSQHLAMDPRVTRVESFTLGGTARENPQPIKTLGHNLIRFKSGVNVYNMTPTHANTIVCDIGESDPKPEVETSRTLRVLKTLELWLARNPNAEFVCKVLCPYPVEVLKCLETLQHKYGGRIIRSTYSRNSSAEMYYISGGRNNMVKVIFTTLHSLISRIRTRPEKIVKESVSLPVGTRSDPGHKIKSMDPKMIATRVEKIKKEHADTWFVDNNHPYQSFRYVGSYVTDDVTPGGQTVNPLMRKMMWPWETVGGVVNFMMTDVSTYAQQKVLREKVDTLSPEPPNDIQRVNRWITEFLCASFMRRGLKPRILTMEQYINNVKSSAAIGSWSSDVPWSSVREALADKRFHQMVEEERKLHLAGDCRMCVYNTMGKKEKKPSAMGVAKGSRTIWYMWLGSRFLEYEALGFLNEDHWVSRDNLACGVGGVGVNYFGYYLQEIARKGKFFIADDIAGWDTRINESDLADEEFLIMSLICDPYHRSLAKAVFRFAYQNIVALFPRNHPGFGSGTVMDVVARTDQRGSGQVVTYALNTITNAKIQLGRMLEAEGLLDAHEHVIKKWLNDNGEEALSGMVVAGDDVVVATNNGNFSRSLRYLHLNGKIRKDIDPSLPSKVETNWEVVEFCSHHYHVMTLKDGRRIIVPCREQNEIIGRGRIQKGGLVTLAESACLAKAYGQMWALYFFHRRDLRMAFLAITSSVPIDWFPEGRTSWSIHQNKEWMTTEDMLRVWNTVWIQDNPWMEDKMEIENWRDIPYLPKSMDLKCGSLIGTKERAAWSKDLPSTVTAVRKIIDQDTKTENVYQDFLGGMGRFQTYTDPMAT

SEQ ID NO: 385 - DNA, 12120 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaagttaacccgtggttttaccctagtttcggtgaatttgccaattttacggaataactgtttgaaaggttcaaactctggtgtccaacgtttgtattaaaatgagtggattaggaggccttcttcccctccgagggaagaaaaagaaagcccctgtgatacaatcacagggcagggtcttgccgaagagcgactggaagggagctccgaaacaggatctaaataaaaagaaagcgaaaaaggacgagacgaaaggccagaattggccaagaagaattaacccccggactggacaatggtcggcaattgagggctctggtgctcggctgtggagaagcattttctctacagacttgatcggaggcttgttgttgttgatcgctattttatcaaatctctacgaaaaggttagacgtgacataacggaattgaaacgcagagtgactcgattggaaaaatctcgagctagtttgattttgaccccaatggtgttgctgtgtctggctatcctcgcggcaggcgtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctgacattggatgtggcattgattttgacaggaagacctacacgtgtggaagcggtctattcgtgtggaagggtttgggaaaatacccaacggccgaccattctgttgagtttgcctcatatgattttctatcagcgtacctccaggagcagtttaagtctgagaagaaggtttgtattatttgtgaagacattgtccagtgtgaggcagctagaaaagcagccgctgcggtgtataaaaacctaggccacccgtttgtctacgtgaacacgtcggactcctatggaaaagtatttgccgaaatcccgaaaagagtccacactgttagtgtgggagtcgacgttgtggaaatggccatgatgactagggagaacaaaccggttggaccgtttggtgacttaccgcgtagtatggtttcgtggaagagtatccctgaaacagaagagcacccagtgttgagagtgttgacatcttcaagtgattaccagaaggtatgtggaaaagcgattggattccagtatgattttgttggataccgtcggaccatgtatggatctaatgtccagttaaaaatatcaaagaaggtttcgattgaatgtcccacatacttggcaggagtcgccgtgaaaaatgatagaacggttttcactgatggaatgttctggatgtcatcgaaacgtgagaatggaacatacgcgatcactgagttagagatggagcagtcccacaagtgcatctggccagaccaatacactcctgacgccactttgacgccacgtgacaatgaaatgtttgttccgcctgagtggggagggccaatgtcgaaagccaaccacattcctggttacaaaatgcagactggatttccatggaacaaagcccccattcggtttgttgagggaagtgttccaggaaccattgtcacacagattagccactgtgatggtagagggattgcagccgaagtgaatccagcaacgcagcccaattggtgctgtaagtcctgtacaaggattttccactttgaagtcgatgggaaactctattatccaatggagattcggcccgacccgaaaggaggggaacagcaaaaagttcctgtagtggagacacccattggagatgaagaaaccgagactgttggtggatggctgggtagaatgtataacattccaggagctgagggatcatatgcggattttcgactccccaagttgccaaattcaagaccaagcgcaatggtggggagtttggtcaatctattatgcttgatgttttcaattcagatagttaccaagactatgcgggcaagaacgcttatgcgtttctatctttgttgcttggtttttatgttctttggaatgccaactttgtttggattaagtgggtttttggcgtggatgatgattctaccaatctcacacaactcggtaacaatgtgcaacctaaccgtgcatctgtgggctgtactgctaaaccagagctcggcgatgtttctgtggggcctaacgctccgatcccagatacagaggtctaccgctggacagatgctactctttaccatgcagatgttgcatcacgccatctacgcgcactcttgggtgttcgggtgggtcatcgaagtatgcttgtcagtcgggcttatgatgaacttgttaaccgtcatcgatacggttcacccgaaactgatcgcatacttgctcttcttcggatggaaaacgggcatgtgcgtagtgtgcgcttggttattgatatactcaatcaggagatggaactctatagtcgccgcggctccggccgcgggcgggtggaggtcagggtatcgaacaatgatgtcctccagtttgattgttatctttatcagtgtaggaattgcaggagttatcgcttcggactatggaggttatccggctgcggctgcggtgactgcagcattgttgataatgggaatcaaaatgtttgactttctgacgacccgattgtctcttgagttcgtatctgcaggcatgttccccgaaggtgttgaaaaagcctttgaaccggactcggtcagtgacttgtttagggcatctttcactgtagatgggataaagttgcaggaccatgttgaaccgatccccattttgtttgccattttgtacatctttattggagctgtggcctgtaaggttaacccggccctcggaatagtgtatgctatcgccatgttcgcgactcctttaccggagttaatgcgtttatacatgatgaccatctattcctctacatttcggacagacactctgcttgggatggctatcccagaaacggagccagaactgtctcaagactttgggccaatccctgatgggatttatcgggtgaacaatcatggattttcagtgaagagtcatcggggagttggaatcgtaaagaatggggtttttcacactctcatgcatgtcacgctcaatgagccactcgcgtggcaaaatcgcctagtaggaccttcaatgggccactctctcaaggactatgtcacatacggtggaaactggcaattgcctgactttgatattgttaatgaggtgggcataatggtttgtggacgggatcgttccattcagtacaaaagacacgaggttgggacaatcatgatcgacgacaagcgagtgatgtacttcactcatgattacgggcacggatcatctggttcaccaatttttgtgaacggagaacctgtggccttatacggcttcgggttccatttgtacaataggtatcgatcaatagttctgcctatcccacgtgaagaagtccttgatggggctagtaatgagggcataccagctgagcacggaaccatgcgcaacaagttttttgttgactggcatccaggaaaagggaaaacccgaaaagtgatcgttaaagaggtgttaaatgctttgaatttagcacggcggattgttgttctggcccctacacgagttgtcctggctgaaataactaaggcaataggggaaaacacatcaaaaacgccctcaaaaaatcttgctttcaccggtcacaatattgtgacggtggcttgccacgcgacgttcactgattatgttttgcgtcatgggttatcaaaattcaaagctcacgaagtcataatggatgagtgccattttctggacccacgatctatagctgcgagaggaatcctggagcatctggcaactaaacgtggagttaaagtcacgtttatgagtgcaacgatcccaggacgtgaaccttcactcgggtcgaattttgagatctctgaacaggccttgcagtttccccgtgacgtcaaccaaaggtggatagaaactgttgctaggggaaagaccgttgccttcgtgccatctcacagggtaggtgacaagctagctcgcgggtgtccccaagccatttccctgcataggaacaattttgacaccaattacagcacagctatggatgagtccataaaatttatctacaccactgacatatcggaaatgggagccaatttcagtgctgacaccgtcatagatttccgggtggcgattaagccaaagatttctagtgaatttgccgtcactcttgaaccaactccgatcacgcgatcatcgatgattcaacggcgtggtcgagttggaagacaacgacctggaacctatatttacccagttgacaaaggcgtcgaagatgcctccgatcagttggcttgttggacagaagctcagatgttgttggatcaattggacttgacaatgatggcagaggaagttcggcagtcaaacattccaggggcttacaaattagttgggcgtagcctagacatatttcggaagttgctggagaaggatgacataccaatctggctgagctggaagtgggccgacagtgttcaacaacaatactccatattgtttgaaggagaacgtcaagagaatgtcgctcgtgtcgtcaacactcgagactatgcttctctagagtataagccgaagtttgttgatgcacgattcgagcgtcttggatgggatcaacgaaagctgtcaattcagttttacatgaacactcggagcttcataactttcgccactttgtcacacgtcatttctcaagtgatcgaagctggagttgtcaattctgcttggaagcgaataggagacgttagcatcatctttactgaaggaggcgacccacatgctaaagatgaaactatcatggcttggactattctggttggaggagtgttgggggctcttggattcctcatagttgcatggggaatgaaggctgtcttgcgagtaattttcggatcccgcgataagcatcttagcgtcccaaccttagtggcggatttccaaccatacatagtgtgtatagttcccattgccctacatcttgctggggttcctataccaatgacaattgtgtttttcgcgatgcttttcttgacttatccactaatgtacaagagtgccggacaacggagttatgttgacattgacttggtgaaatggattctgttaggtggatgtattgtaactggagtcatttgctgggaaatgagattgctcccaaacatctcatcagacatttcagctattttgaataggcaaagacaaagggaagacaccccaacttttgatgcttcaccaccttgggaatggttggatttagcacagccagtccctcacaatgttgaattgacgtcagtggtgataactacattcacgacctggctgttcttgcaccaaattgtcggatggtcatacgagtcagagtggctgaaatcctatttcgaccacaaaggagtgggtcagatcatgggtggttttcggttggacacaatttcatggggatcagctctaagcggtcttctgggcacagctacttatgcctcatggggagccattttgactgggttaggaggagcggttgtgtattttttcctgatggtttcaatgctcaagtggaacttttcgggaggagccacaactggcttagaaaacaatgtcatgcgaaacgaccgagaaactggactaggtaatcggccggcaaacgacaataggcgttccctcctgtacggtgtggtggcggctgaatgtcttgtgtggttgttctgtttcagaactgccacggatgccatagtggtggcttgtttagtgtcctattgtttatggatcatcaacaacccggctagccctcaccacaaaaacactgacttaggatcggcgtgtagtttcatcggtcttttgtactgtacatgtcctactcaaaaatgcatccaagtattgatgaggtttgctttggccaggttgaacatgaacacccgctctctggaaaaaagcgcgacgggaggccttggacaccgttggaagaagctattaaatgcgatgacactattggaattcaacgcttaccgatcttgtggagttgacgagactgagaagggtgactatgtgtcacgaggagggctgaagctgagagagataaccatgaagtatggttggaagccagaagggatatgtgttgatcttggatgcggcagaggaggatggtcacagcacttggctatggatccccgcgtaactagagtggaatcattcacgttaggaggaacagcacgagaaaatccccagccaatcaagacacttggtcataaccttatccggttcaagagtggagtcaatgtgtataatatgacgccaacacatgctaacaccatagtgtgtgatatcggagaaagtgaccccaaaccagaggtggaaacctctagaacattgcgggtcctcaaaacacttgaactatggttggccaggaatccaaacgctgaatttgtgtgcaaagtcctttgcccataccccgtggaagtcctcaaatgtctggaaacccttcaacataagtatggcggaagaattattaggtcgacgtatagccgaaattcaagtgctgaaatgtattacatttctggaggccgtaacaacatggtgaaggttatcttcaccaccctccactccttgatttcgaggatacgaactaggccggagaaaatcgtcaaagaaagtgtttctctaccagttgggactagaagcgatccagggcacaagatcaagagtatggatccaaagatgatagcaacgcgggtggaaaagataaaaaaggaacatgcggacacgtggttcgttgacaacaaccatccataccaatcatttcggtatgtgggatcgtacgtcacagatgatgtgacaccaggaggtcagactgtcaacccattaatgagaaaaatgatgtggccgtgggagactgttggaggagttgtaaatttcatgatgacggacgtgtccacatatgcccaacagaaggtgttgcgagagaaggtcgacacactatcccctgaacctccaaacgacattcaaagggttaacagatggatcaccgagttcttgtgtgcttcattcatgcgtcgagggttgaaacctagaatcctgaccatggagcaatatatcaacaacgtaaagagctcagctgccattggatcgtggagcagtgatgtcccgtggagcagtgtccgagaagctttagctgataaaagattccaccaaatggtcgaggaggaaaggaaactccacttagcaggagactgccgcatgtgcgtgtacaacaccatgggcaagaaggagaagaaaccttcagccatgggcgtggccaagggctctcgaaccatttggtacatgtggttaggttcacggtttttggagtacgaagcccttggcttcttaaatgaagatcattgggtgtcacgagacaacttggcatgtggtgttggtggagtgggagtgaattacttcggctactacctacaagaaattgcacggaaagggaagttttttatcgccgatgacatagcgggatgggacacgcggatcaatgagagtgacttggccgatgaggaatttctcatcatgtccctcatttgtgacccataccatcgatcacttgcaaaagccgtgtttcggtttgcctaccagaacattgtggccttgtttccgcgaaatcatcctgggtttggaagtggaacggtgatggatgtcgtggccagaactgaccaacgaggttcaggacaggtcgtgacttacgctctaaacacgataacgaacgccaagattcaattaggcagaatgctggaagccgaaggattactagacgctcatgaacatgtaatcaaaaaatggttaaacgacaatggtgaagaggctctctccgggatggtggtggccggggatgatgttgtagttgcgaccaacaacggaaatttttcaaggtccttacgatacctccatttgaacgggaaaattcgtaaagacattgatccgtccctaccgtccaaagttgaaacgaactgggaggtggttgaattttgttctcaccattaccacgtgatgaccttaaaggacggacgacgaataattgtcccatgccgagagcagaatgaaatcattggacgaggcaggattcaaaaaggagggttggtgacccttgccgaaagtgcctgcctagcgaaggcttatgggcaaatgtgggctttgtatttctttcaccgaagagatctgcggatggcttttctagccataacttcgagtgttccaatagactggttcccagagggccggacctcgtggtcgattcaccaaaataaagagtggatgaccactgaggacatgttgcgggtctggaatacagtgtggatccaggacaatccctggatggaggacaaaatggaaatcgaaaattggagggacattccgtacctcccgaaatccatggacctaaagtgcggcagtctcattggaacaaaagaaagagccgcttggtcaaaggatctgccgtcaacggtcacggcagttcggaaaattatcgaccaagacacgaaaaccgagaatgtctaccaagactttcttggcggaatgggccggttccaaacgtacactgaccccatggcaacgtaagaaaccatcttttccaaattagtcgaaaaattttgcccctcttcgaggggctttggcggcagcaggagattttctccggggtttcacgctccccccgatgccagtggtcacagcccaagtcagagacttggagttgtggcgggacagtgagctctgtcagtggtcaatagctcaataaatatggcagcagagcttgtctcggggattcacgctccccccattgtgagtgtgtcgaactggtttcgaaggacgtctagaacgacgctaaagttcaaatccggcaacagagagtttatgtctcggggcctcacgcaccccccgttgtgagtgaagtcctttctggccatttagtggtcaggaagggtaccgttttggaacgacggaaataagttccatggagcgacactagccccactgaggggcggttggaatgacacccaacccgctatagtgcgtcgacaggtcaattagctacctggaataagctaatgtgcagggcaacaaagttctaacgaactagggtgagtagcgtcaccccccggttgtgaaaacgattgcgactagaactaaagtcgagagtctccccaccgataggggagctcgtcagtttgttttagtccaattacgct

SEQ ID NO: 386 - DNA, 10745 bp, Lilly Creek virus
tacgtagaagtataacacgttgaagtaaagttttgaatcaagagataaatcatggttacaaaactcaggaggcccgcaaggcgggctgtcgatatgattaggcgtgcggtaccccgcgccgcaggaccacgtaaggtcctaactagggtatcaaacaccatgaagcgcaatgctggggcattgagagctctcttggcctatcttcttttccagacatttgctggaagaaaggtaggcactagagcccgcaccgcactcaagcgcttcaataaaaatgacatcgtgaaaatgctgctggctttccgaagaacattgacgaacataatcaccaccatgcaacgccgcgtgaaagggaaaaaccgaaggggattgcaggaagtgtcattggtcgttacagcgctaatggttgtaggagtcttctctgccacgctaaagactgtgggagaatattcatggctcaacgttacaagcaatgatgtaggaaaatggatccgagtggaaaacagaaatggacgtggagagtgctttgtgacagccactgatgttggaacatggtgtccagactcagttggctacgagtgccctcaggtagctcctgcttatgatccggaagacttagactgttactgtcggaatacatccacttacgtcacgtatgggagatgtaagaatggaaaaaatggccgatcacgtagcaaacgctctgtgaccataacgccacatggagaagctggcctgcgcgttggaagcactaaacactggacatcccgagcttcgcctgaacgctacctaatgagagtcgaaaagtgggtgctgaggcatcccctaccggcgtttgtgctggtgatcctaggatggatgatgggaagaactcatgggcaacggatcatgtacatactgctaatgcttctcgtggccccatcctatggcaaccaatgcttggacgtgcaatctcgggactttgtccagggtgtcagtggagggacatgggttgacgtggttctagaccatgataattgcatcactattgttgcggatggcaagccatcatttgacatccggctgaccaaaatgacgatgacaaagtttgctgattacaaacgatactgccttcaggcgacgatgacagatgtcaccagcatagtggcatgcccaggagcaggagacgcccacaatgacaaaagtaaaaaccatgactacatctgcaaggccgtcaccaatgaccgtggatggggaaatggatgtgtgttattcggaaaaggatcaatggaaacgtgtgggaaattcgaatgtaagaagaaaatggccggtaagttggtggctcgtgagaacgtggaatccgtggtcacagtacacgtgcacggagcgtcagcaactgacaccaagggagtggacactgcttcgacagccacggcgacaataacgcctaaatcctcaactgccagtgtgaaccttaatgactttggcagtgttgaggtggactgttcaacagatgtcggaatggactttggtgaagtggtggtagctgacatggctggaaagtggtggatcgtgaacaaagactggttcaatgaactggctttgccatggtcgacggccagcgtagcagcagaagtctggcaaggacgcgatcggttaatagagttcggatggccacatgcagtaaagcaaaacatatatgacatcggagaccaagaaggagctgtaaccgcagccatagcgcaagcgcccatggcaaaatgggagtctgacaaagttgagcttgcttctggaatcttgaaatgcaaagttaaactgggaaacctcaagctcagaggaatcacatatggtatgtgtactaagagtttcaacatggaaactcgtccagctgacactgggcatggtaccgtagccttcaaattgaaatacactggaagtgatgttccatgtcgtgtgccactgaatgtgattgacagtgacggaggagtagcggctggaagaattatcacagcccaccctttcgttatgaagcaaaacgattacattatcatagaagtggaaccaccattcggtgacagcaagatagaaattggaactggaacgaccaagttgaccgaagcatggcatcgaaaagggagttctattggcaatgctttttcagctacgtataaaggcatcaccaagttgactgtgctcggggagcatgcttgggatttcaactccttgggaggcttcggagccagcctgggaaaagcggtgcataccctcttcggaggagtgtttagggtgctctttggaggcatgggatggctgacgaagatcctggtcggagccattctagtgtggctggggctgggcgcccatgacaagaccatagccactacgatgatagttgtgggctccatgttgatgtatttggcagtgtcagtgggggctctgtcagagattgggtgcagtctggacatcgctagaagagaaatgaaatgtggcgatggagttttcatttttagggaagctgggatgtggaaagaaggttacgcgttccatcctgcagaacctaagacgttggctgcctcagtcctcaagagttggaaagctggggtttgtggagtacgctccacaagccgcatggagcacgcgatgtggaaacagattgagaatgagctgaatggcatacttgaagaaaatgaagctcatttgagtgtagtggtcaaggaaaccaacggcaccttcccccgtggagatcgcagaatgcaagtggcggagcctctgaagtatgggtggaagacctgggggaagaccgctgtgtctactgttcccctggccaaggaaactttcatcgttgatggcagtgatgaaggagaatgcccttcccaactccgagcgtggaactcattccaagttgaagaatttggaacaggcctcctcaaaactaaagtcttccttgatatctcaacagccgtgactgtccagtgtgacaccaaactgcttggagcggccatcaagggaaacaaatctgtacatggagatcctggtttgtggatggtgtctgctgagatagatggtgtctggcagataactgaattgaccctagctgaaagtcgaagatgtatgtggccagactcgcacactgtatggggccggaatgttttggagagcgaactcattcttcctcctacgtacgggggaccagtgacaaacatgaacaagcgtagaggatacgccacccaagtcagtggaccttggaatcatgtgcccctgaaggtggtcttcgaggaatgtcctggaaccaccgtgacgattgaacctaactgcaccaagcgatcagaatcagtccggtccactacggatagtggaaagataatatctgactggtgctgtcgttcgtgcactatgccgcccctgacataccgcacccctgacggatgttggtatgctatggaggttcgaccgaagaatgtcaaagaggagagcttaattcgatcacatgtggcagcaggagtattcaaaggaatagatgatgtctcactgggattgctcgtcatgataatattcctgcaggaaggcttgcgaagaaagttgacgaccacatatataatgtgggctgccttggtagtgttgacagcaggaattttgggagagctctctctaagagacgtgctgcggtacctcattctggtaggcacagctttctctgaggccaataatggtggagacctaatacatctggctctcgtggccgttttcaaaatcagaccggctttcttgtttggattcttattccgtgcgaagtggtcacccagagagggagtgcttttagcttcaggagcattaatgctgcaaatagccagtgaatgcctgtacgcaacagccatcatgcaagtcgtggatgcattgagcatggggtggctcatgatccgtgccattgctatcccaggaatgacgtcaaaggccatgcctctgttatgtgcatgtatccctgctgtcacatccctgctagtgcattccacacgagttggagttatcaccttggctggcatgtctttgattgcgggcaacaaaggctcatctgtcaaaaaacatggtccgtatttggtagcactaataaccactgcgatgggagcaagtccggttggaatgctggccatggaggcgttttcccacttaaagtctaggagatcttggccagctggtgaaatgatgtcagctgtgggactgacatgcgcacttgttggagccataagtggtacgtcatcacatgactttgctgggcccctggctgcagcagccctcatcatcatagcatatgcgataagtggaaggtcagctgatgtatacctagaaaaagctggagagatctcttggagtgaggatgccaagatatctggatcaagtccacgcatagatgtatgcgtgaccgagaacggggatttcaaactgcggcatgaaggggaagcaacttggactcgcaactgcattctagctgcctgcttaatagtggctggagtgcatccgttgggcattccagtggctggattgatgtggttcggatatgtaaaagctaacaggagaggcacggtgctgtgggacattccgtcaccacagacaaatgcagctccaactgtagaagatggatgttaccgtgtaatgtcgaagagactcctggggagcacccagcttggagtagggatcatgttggattcaacattccacaccatgtggcacatcactcgaggggcttccatagtcagtggagaaggacgcctagatccgtactgggctgatgtaaaagaagacctggtgtgctatggaggaccatggaagatccgtaacatgtgggacggcatgtctgaagttcaattgatcgcggtgccaccgaaggaaaaccctgtcaatgtgcaaaccatgcccggcaaattcgtggttgccaatggaggtgagataggagctgttgttcttgactaccctcctggaacttctggatcccctatagttgatcaacaagggaacgtcattggactgtatggaaatggagtcatgatcaatgatcagacgtatgccagcgcgatagcacaagctccggttgaggcagcgcgaacccccacctggtttagtgaggacatgttacgcaaaggccaaatccatgttctggacttacaccctggagcaggaaaaacacgcaaagtgctccctgaaattctaaaggcagctgtggaaaaacggttaaaaaccctggtcctggcccctacgcgggtggtggccaaggaaatgcatgaggctctaacgggactccctgttagataccagacatcggccataccaccaacatcgtctgggggtgaactgatagatgtaatgtgtcatgccacatacacacacagacaactaacccctgggagaggcattaactatcagctctatatcgtggatgaggcacatttcacggatccggcatcaatagcagctagaggaataatagcaactagagtgcgcctggggcatgccgctgcaatttttatgacagcaacaccccctggaatgtccaacccctttccggagtctaatgcacacatagaggacgaggaacgggaggtgcccacaaaggcttggaactccggatatgaatggatcacagactacagtgggcgaacggtgtggttcgtgccatcaatacgcatggctaacaccattgcctcatgtttagtgcgagccggcaaggtggtgatcgtcctccatagtggatcatttaatgaggagtatcagaaaacaaagtctggcaactgggactttgtggtcactactgacatatcagagatgggagccaatttcaaagcctctcgagtcattgactctcggctttctataaaacccatgttctcttatgcccctagtgagcgcgttgttataggtatgcccaggccagtgtctccagctagtgcagctcagcgccgcggacgggtcgggagggaccctagacaacttggagaccagtacatatatggaggtcccatcggagaggactcagcagaatacgtccattggactgaggcgaggatcctgatggacaatgtcaccgttccaggtggtctgtacccacagttctatgaacctgaaagtggaatgtgcaacgccatggatggggcccaccgattgacagacaccaaacgagaggtgtttcgagaccttatgaaaaaaggagagctaccggtatggcttgcgtaccaggtggctcaagctggacacgcgtacacagacagaacatggtgctatagtggaccagctgaccatcaggtgtacgacgactgtgggcaaactgtggattacagatcactgaatggggagcgacgcatgctcagaccaaaatggctagaccagcggacgtacaatgataagacctctttgaggctttttactgagttcgcggagggtcgtagacggtattcagagcttattgatgtgttcggccgcatgcctcaacacatgctggacaaaactatattagccgcagatacattcaaggatgtgctcacagccactcctggatcccgtgttcatcgcttggcgctggacaacttgcctgaagccacggaaacgataatggtactgggaatattgagtgtgtcgacgctgggagttatcttgttcctcatgtccccaaaaggaatgactcgcatgacatgtgggttggtggttattatactggccacttatttcttgtgggtatcagggatggcaggttatcaaatagcggctgttcagctcatggcctttgtgctgtttgtggtactggttccagaaccaggatcacaacggtcggtacaggacaacacgattgctatcatcttgatagtcatcttgtctttggcagccgcaatagcggctaatgaagctggactattagaaaagaccaagaaagatttcacgtggagaaaggagaaaccgacacaactggagacaagtccctggaacatagacttttccatggacctccggccagctactagttggtcactgtacgtagtgatggcaaccatgctgggaccagtgctcgagcatgcgattgtgactaactatgcgagtgtttctctcacagcaattaccaatcaggccggaatcctcctgtccatggataagggaactccgttttggaatctggactggagtgtcgtgttgttgtgtgttggcagctggtcaggaataaatggaactaccctcatggtggcatcggtcatgactgtgctacattttgcgatgattcttccgggaattcgcgcaaaagcagctagagaagctcagaatagaacagccgctggagtgtctaagaaccccctggtggacgggatgaacaccatcaacatccagccgctaccggagctagaccccatgtacgagaggaaaatgggtctgtggatgctcattgcagttgctggagcagcggtagtcttcgacaagaggatgctgcactatactgaattcggagtactaggttctgcagccattacccctctagttgaggggtatgcatctgcagtctggaacacctccgtggctgctagtgtgtgcaacttaatgaggggacattacatggccggagttccaatggcatattctttgatcaggaatttgtcaatgaaaggagtgtctagaagaggaattcaggctacacgcacacttggcatggtttggaaacacaagctcaacaccatggacaaagccatgttcaatgcatacaaaaaggacggaatcactgaagttgacagggagccagctcgagcggctatgaaaaaaggagatctagtaagtgggtgggctgtctcgagaggatcagcaaaactcagatggatgcacgaacggggattcatcccactgcaaggaacagtggttgacctcgggtgcggaagaggcggatggagctactacgcagccgcacagcgaaaagtgacgtctgtcaaggggctaaccaagggaggccctggacacgaggaacccgttaacgtccagtcttatgggtggaatctaatctcgtttcggagtggagtagatgtcttccacactgatgtgcaaccagcagacacactgctgtgcgacataggtgaatcgtcatctgatcccaatttagaaaagacacgcacacttcaagttctggttaattttgagaggtggcttaaggagtcaaaatgcgaaaatttctgttgcaaagttctcggaccttacttaccagaggtcatggaacggcttgaccgactcacaaaaacttatggtggagccgtcatccgaaatcctctctccaggaattcgacacatgagatgtattgggtctcgggcgctaagggcaatcctgtcaatgcgatcacaactacttcccgagtgctgctggagcgcatgtgtaggcgggtagggaaaagttactgggaagaggacgtcaatcttggaactggaacccgagcagtaacctgctcagctgaaacaccagacatgtcgaagataggaagacgcattgagttgctcaagaaggagtacagggcgtcctggtttgaggatcctgaacacccctacaagacttggacataccatgggtcatatgaaaccaagaccactgggagctcgtctagtatgatcaatggagtggtgaaggagatgactcacccatgggacacaaatccaagagtgactacagtgtgtatgactgacaccacaccttttggacagcaacgtgtgtttaaagagaaagtagacaccaaggcgcgtgaaccatccgatggcactagagaagtcatgaggattgtcagcaaatggctcacgatgtacattggccggaccaaaaagccccgcatttgcacagcggaagagttcatcgcgaaggtaaactccgatgctgcacttgggacgatgtttgactcccaaggaacgtgggcgaacgccagagaggcagttcaagacccaaggttctggcagatggtggcacgtgagagggaactccacttgcgtggacaatgcgccacctgtgtctacaacatgatgggaaaaagagaaaagaaaatgacagagtttggcaaatcaaaaggtagccgagccatctggttcatgtggctaggagcccgctttttggaatttgagagtctgggtttcctaaatgaagaccattggttgtcgcgagaaaactcaggaggtggtgttgaggggataggtctgcaatacctgggttatgttctgcgggacatggctgcaattccgggggggcggatgtacgctgatgacaccgctggctgggatacacgcatcaccaatgctgacttggaagacgaaatggacatattggatctaatggatccccaccacaaaaagttagctaggaacctcatggacttggcttacaacaataaggttgtgagagtcatgcgccctggtaaaggaggcaagactctgatggacatcatcagtcgcaaggatcaacgcgggagtggtcaggttgtgacataccctttgaacacctggaccaacttgaaggtgcagctcatccgcatggcagaggctgaaggggtgcttgacccgcgtgaagtagagggcatcacacacacaacgaaaaacagtctcgagaagtggctcacaaaccacggagctgagcggctgaaacgcgttgcagccagtggagacgatgtcgttgttaaacccattgacgagcggtttgcgtccgctctcacataccttaatgacatggcgaaaactagaaaggacatctgcgaatggaaaccatcaactggctggtaccactgggaggaagtgcctttctgctctcaccacttccaccagctcatgttgaaagatggtagaactcttgttgtgccgtgtcgggaccaggatgagctgattggtagagcacgtgtgtcccctggagctggatggaccattaaggaaacagctggtcttagcaaggcttacgcgcaaatgtggctgttaatgcacttccaccggagggatcttagaatggctgggtttgcaatatgcagtgcggtgccagccgcatgggtccctacaggacggacatcgtggtctctgcatgccaaaggcgaatggatgaccacagaagacatgcttgaggtctggaaccgtgtgtggatagaggacaatccacacatggccaacaaaacccgcataggatcttggcaggatatcccataccaacgcaaatccctggatatacattgtggctcaatgataggacaacgctccagatctacatgggctgcaaatatacgcataagcatcaatcacgtgcgcaggttgattgggagcaatgaaaagtacctggattacatgcaagagcaagagagattcaggcaaccaacaccaactcggcttggtaacgtgatctaaaaccctacaaaatttcaaaaacatgaccgagtcaggcctctacggagccagcattaatgagagtaagtgctgctgcctgtgtctctccagaacaccttacgcgccaaatgtgttctgacactataccagcgcaaaactaggccccacaagggatagggtaatggttgtgaacccctagcgtctaaatcaacctcatagtggaatggcgcccgaccactataaaacatggcactaatagaagggcaatgggtagctcgacccattaagtaaacaccctattaatatcgagcatcatatcgacacctgggaaagaccggagatacctcttgcttcacagcgctcaatccacaaggcacagtacgccgaagaattgtggattgggaattgagaaa

SEQ ID NO: 387 - protein, 3433 aa, Autographa californica nucleopolyhedrovirus
MVTKLRRPARRAVDMIRRAVPRAAGPRKVLTRVSNTMKRNAGALRALLAYLLFQTFAGRKVGTRARTALKRFNKNDIVKMLLAFRRTLTNIITTMQRRVKGKNRRGLQEVSLVVTALMVVGVFSATLKTVGEYSWLNVTSNDVGKWIRVENRNGRGECFVTATDVGTWCPDSVGYECPQVAPAYDPEDLDCYCRNTSTYVTYGRCKNGKNGRSRSKRSVTITPHGEAGLRVGSTKHWTSRASPERYLMRVEKWVLRHPLPAFVLVILGWMMGRTHGQRIMYILLMLLVAPSYGNQCLDVQSRDFVQGVSGGTWVDVVLDHDNCITIVADGKPSFDIRLTKMTMTKFADYKRYCLQATMTDVTSIVACPGAGDAHNDKSKNHDYICKAVTNDRGWGNGCVLFGKGSMETCGKFECKKKMAGKLVARENVESVVTVHVHGASATDTKGVDTASTATATITPKSSTASVNLNDFGSVEVDCSTDVGMDFGEVVVADMAGKWWIVNKDWFNELALPWSTASVAAEVWQGRDRLIEFGWPHAVKQNIYDIGDQEGAVTAAIAQAPMAKWESDKVELASGILKCKVKLGNLKLRGITYGMCTKSFNMETRPADTGHGTVAFKLKYTGSDVPCRVPLNVIDSDGGVAAGRIITAHPFVMKQNDYIIIEVEPPFGDSKIEIGTGTTKLTEAWHRKGSSIGNAFSATYKGITKLTVLGEHAWDFNSLGGFGASLGKAVHTLFGGVFRVLFGGMGWLTKILVGAILVWLGLGAHDKTIATTMIVVGSMLMYLAVSVGALSEIGCSLDIARREMKCGDGVFIFREAGMWKEGYAFHPAEPKTLAASVLKSWKAGVCGVRSTSRMEHAMWKQIENELNGILEENEAHLSVVVKETNGTFPRGDRRMQVAEPLKYGWKTWGKTAVSTVPLAKETFIVDGSDEGECPSQLRAWNSFQVEEFGTGLLKTKVFLDISTAVTVQCDTKLLGAAIKGNKSVHGDPGLWMVSAEIDGVWQITELTLAESRRCMWPDSHTVWGRNVLESELILPPTYGGPVTNMNKRRGYATQVSGPWNHVPLKVVFEECPGTTVTIEPNCTKRSESVRSTTDSGKIISDWCCRSCTMPPLTYRTPDGCWYAMEVRPKNVKEESLIRSHVAAGVFKGIDDVSLGLLVMIIFLQEGLRRKLTTTYIMWAALVVLTAGILGELSLRDVLRYLILVGTAFSEANNGGDLIHLALVAVFKIRPAFLFGFLFRAKWSPREGVLLASGALMLQIASECLYATAIMQVVDALSMGWLMIRAIAIPGMTSKAMPLLCACIPAVTSLLVHSTRVGVITLAGMSLIAGNKGSSVKKHGPYLVALITTAMGASPVGMLAMEAFSHLKSRRSWPAGEMMSAVGLTCALVGAISGTSSHDFAGPLAAAALIIIAYAISGRSADVYLEKAGEISWSEDAKISGSSPRIDVCVTENGDFKLRHEGEATWTRNCILAACLIVAGVHPLGIPVAGLMWFGYVKANRRGTVLWDIPSPQTNAAPTVEDGCYRVMSKRLLGSTQLGVGIMLDSTFHTMWHITRGASIVSGEGRLDPYWADVKEDLVCYGGPWKIRNMWDGMSEVQLIAVPPKENPVNVQTMPGKFVVANGGEIGAVVLDYPPGTSGSPIVDQQGNVIGLYGNGVMINDQTYASAIAQAPVEAARTPTWFSEDMLRKGQIHVLDLHPGAGKTRKVLPEILKAAVEKRLKTLVLAPTRVVAKEMHEALTGLPVRYQTSAIPPTSSGGELIDVMCHATYTHRQLTPGRGINYQLYIVDEAHFTDPASIAARGIIATRVRLGHAAAIFMTATPPGMSNPFPESNAHIEDEEREVPTKAWNSGYEWITDYSGRTVWFVPSIRMANTIASCLVRAGKVVIVLHSGSFNEEYQKTKSGNWDFVVTTDISEMGANFKASRVIDSRLSIKPMFSYAPSERVVIGMPRPVSPASAAQRRGRVGRDPRQLGDQYIYGGPIGEDSAEYVHWTEARILMDNVTVPGGLYPQFYEPESGMCNAMDGAHRLTDTKREVFRDLMKKGELPVWLAYQVAQAGHAYTDRTWCYSGPADHQVYDDCGQTVDYRSLNGERRMLRPKWLDQRTYNDKTSLRLFTEFAEGRRRYSELIDVFGRMPQHMLDKTILAADTFKDVLTATPGSRVHRLALDNLPEATETIMVLGILSVSTLGVILFLMSPKGMTRMTCGLVVIILATYFLWVSGMAGYQIAAVQLMAFVLFVVLVPEPGSQRSVQDNTIAIILIVILSLAAAIAANEAGLLEKTKKDFTWRKEKPTQLETSPWNIDFSMDLRPATSWSLYVVMATMLGPVLEHAIVTNYASVSLTAITNQAGILLSMDKGTPFWNLDWSVVLLCVGSWSGINGTTLMVASVMTVLHFAMILPGIRAKAAREAQNRTAAGVSKNPLVDGMNTINIQPLPELDPMYERKMGLWMLIAVAGAAVVFDKRMLHYTEFGVLGSAAITPLVEGYASAVWNTSVAASVCNLMRGHYMAGVPMAYSLIRNLSMKGVSRRGIQATRTLGMVWKHKLNTMDKAMFNAYKKDGITEVDREPARAAMKKGDLVSGWAVSRGSAKLRWMHERGFIPLQGTVVDLGCGRGGWSYYAAAQRKVTSVKGLTKGGPGHEEPVNVQSYGWNLISFRSGVDVFHTDVQPADTLLCDIGESSSDPNLEKTRTLQVLVNFERWLKESKCENFCCKVLGPYLPEVMERLDRLTKTYGGAVIRNPLSRNSTHEMYWVSGAKGNPVNAITTTSRVLLERMCRRVGKSYWEEDVNLGTGTRAVTCSAETPDMSKIGRRIELLKKEYRASWFEDPEHPYKTWTYHGSYETKTTGSSSSMINGVVKEMTHPWDTNPRVTTVCMTDTTPFGQQRVFKEKVDTKAREPSDGTREVMRIVSKWLTMYIGRTKKPRICTAEEFIAKVNSDAALGTMFDSQGTWANAREAVQDPRFWQMVARERELHLRGQCATCVYNMMGKREKKMTEFGKSKGSRAIWFMWLGARFLEFESLGFLNEDHWLSRENSGGGVEGIGLQYLGYVLRDMAAIPGGRMYADDTAGWDTRITNADLEDEMDILDLMDPHHKKLARNLMDLAYNNKVVRVMRPGKGGKTLMDIISRKDQRGSGQVVTYPLNTWTNLKVQLIRMAEAEGVLDPREVEGITHTTKNSLEKWLTNHGAERLKRVAASGDDVVVKPIDERFASALTYLNDMAKTRKDICEWKPSTGWYHWEEVPFCSHHFHQLMLKDGRTLVVPCRDQDELIGRARVSPGAGWTIKETAGLSKAYAQMWLLMHFHRRDLRMAGFAICSAVPAAWVPTGRTSWSLHAKGEWMTTEDMLEVWNRVWIEDNPHMANKTRIGSWQDIPYQRKSLDIHCGSMIGQRSRSTWAANIRISINHVRRLIGSNEKYLDYMQEQERFRQPTPTRLGNVI

SEQ ID NO: 388 - DNA, 11818 bp, Artificial Sequence
  Synthetic
ggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatctgggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctgtcactctctccaactttcaagggaaggtgatgatgacggtgaacgctactgacgtcacagacattatcacgataccaacggccgctggaaagaacctgtgcattgtcagagctatggatgtggggcacatgtgtgatgatactatcacctatgaatgtccagtgttgtcggccggaaatgatccagaagacattgactgctggtgcacgaagttagcagtctacgttaggtatggaagatgcaccaagacacgacactcaagacgcagcagaaggtcactaacagtgcagacgcatggagagagcaccctatcgaacaaaaagggggcctggatggacagcaccaaggctacaaggtacttggtaaaaacagaatcatggatcttgagaaaccctggatatgccttggtggcagctgtcattggatggatgctcggaagcaacaccatgcagcgtgtcgtgtttgccgtgttactgcttttggtagctccagcttacagctttaactgtcttggaatgagcaacagagatttcctggagggagtgtccggagcaacatgggtggacttggtccttgaaggtgacagctgtgtgaccattatgtccaaggacaagcccaccatcgatgtgaagatgatgaacatggaggccgctaacttagcagaagtccgcagttattgctacttagccactgtcagtgaactctccaccaaggctgcgtgcccaaccatgggggaagcccataatgacaagcgggctgacccatcttttgtgtgcaaacaaggagtagtggatagaggttggggcaatgggtgcggactttttggtaaaggaagcatcgacacatgcgccaaatttgcctgttcaaccaaggcaacgggaaggactatcttaaaggagaacattaagtatgaggtggctatctttgtgcatggaccaactaccgtggaatcgcatgggaactacttcacgcaaaccggagctgctcaggctgggagatttagtatcacccccgcggcaccctcttacactcttaagctcggagagtatggagaagtaacagtggactgtgaaccacgctcagggatagacaccagtgcatactatgtgatgactgtcgggacaaagactttcttggtccaccgtgagtggtttatggacctcaacctcccctggagcagtgctgaaagtaatgtttggaggaacagagagacgctaatggagtttgaagaaccacacgctacgaagcaatctgtgatagcattgggctctcaagagggagccctgcatcaagctctggcaggagccattcctgtggaattttcaagcaacactgtcaagctgacgtcaggccacctgaagtgtagggtgaagatggaaaaattgcagctgaaggggacaacttatggcgtctgttcaaaggccttcagattccttgggactcccgcagacacgggccatggtactgtggtactggaactgcagtacacaggcacggatggaccctgcaagatacccatttcatcagtagcttcattgaatgacctaacgccagtgggcaggttagttaccgtcaacccctttgtctccgtgtcaacggccaatgctaaagtcctgattgagttggaaccaccctttggagattcgtacatagtggtgggaagaggagagcaacagatcaaccatcactggcacaagtctggaagtagcattggcaaagctttcacagccaccctcaagggagctcagagactagcagctctgggagacacagcttgggactttggatcggttggaggagtgtttacctccgtgggaaaggctgtccatcaagtatttggtggagcattccgctcattgtttggaggcatgtcttggataactcagggtctgctgggggccctcctattgtggatgggtattaacgctcgtgatagatccatagccctcacgttcctcgcggttggaggagttctgctctttctctccgtgaacgtgcatgctctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaa

SEQ ID NO: 389 - protein, 3441 aa, Artificial Sequence
  synthetic
MVTKLRRPVKRAVDMMRRAVPRAAGPRRVLTRVSNTVKRNAGALRALLAYLLYQTFSGRKVGSGARSALKRFNKNDIVKMLLAFRRTLTNIITTMQRRVKGKKRRGVQDVPLLVLLLVGAGAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSALSEIGCSLDISRKEMKCGDGVFIFREAGMWKDGYAFHPSEPKSLAASVLKSWQSGVCGVRSTNRMEHAMWKQIENELNGILEENEAQLSVVVRESNGTFPRGERRMHVAEPLRYGWKTWGKTAISTVPLAKETFVVDGNDEGECPSQMRAWNSFQVEEFGTGLVKTKVFLDISTALTAQCDTKMLGAAIKGNRSVHGDPGLWMVSAEIDGTWQIIELTLAESRRCTWPDSHTVWGRNVQESELILPPSFGGPMTNMNKRKGYATQVGGPWNHVPLRVVFEECPGTTVSVEPNCTRRSDSVRSTTDSGKIITDWCCRSCTMPPLTYRTPDGCWYAMEIRPKNVKEESLIRSHVAAGVFKGIDDVSLGLLVMIIFLQEGLRRKLTATYIMWAALVVLIAGILGELTVRDVLRYLILVGTAFAESNNGGDLIHLALVAVFKIRPAFLFGFLFRSQWSPREGVLLASGALMLQIASECLHASAIMQVVDSLSMGWLMIRAIAVPGMTSKAMPLLCACIPAVTSLLAHSTRAGIITMAGMSLIAGSKGSSVKKHSPYMLALVVAGLGARPIGMLAMEAFSHLKGRRSWPAGEMMSAVGLTCALVGAISGASSQDFAGPLAAAALIIIAYAISGRSADVYLEKAGEISWSEDAKISGSSPRIDVCVTENGDFKLRHESEATWTRNCVLAACLVVAGVHPLGIPVAGLMWFGYVKSNKRGTVLWDIPSPQATSAPTVEDGCYRVMSRRLLGSTQLGVGIMLDSTFHTMWHITRGASIVSGEGRLDPYWADVKEDLVCYGGPWKIRNTWDGLSEVQLIAVAPKENPVNVQTMPGKFIVANGGEIGAVVLDYPPGTSGSPIVDQQGNVIGLYGNGVMINDQTYASAIAQAPAEVARTPTWFTDDMLRKGQLHVLDLHPGAGKTRKVLPEILKAAVEKRLRTLVLAPTRVVAKEMHEALTGLPVRYQTSAVAPNGSGGELIDVMCHATYTHRQLTPGRGVNYQLYIVDEAHFTDPASIAARGIIATRVRLGHAAAIFMTATPPGMSNPFPESNAHIEDEEREVPTKAWNAGYEWITDYGGKTVWFVPSIRMANTIAACLVRAGKTVIVLHSGSFNEEYQKTKSGNWDFVVTTDISEMGANFKASRVIDSRLSIKPMFSYAPSERVVIGSPRAVSPASAAQRRGRVGRDPRQLGDQYIYGGPVGEDSAEFVHWKEARILMDNVTVPGGLYPQFYEPEGGMCDAMDGAHRLTDAKREVFRDLMKKGELPVWLAYQVAQAGHAYTDRTWCYGGPADHQVYDDCGQTVDYRSLNGERRMLRPKWLDQRTYNDKTSLRLFTEFAEGRRRYSELMDVFGRMPQHMLDRTILAADTFKDVLTATPGSRVHRLALDNLPEATETMMVVGILSVSTLGVMLFLMSPKGMTRMTCGLVVIILATYFLWVSGMAGYQIAAMQLIAFILFVVLVPEPGSQRSVQDNTIAIILIVILSLAAIIAANEAGLLEKTKKDFAWKRESHVLVTPSPWNLDFSMDLRPATSWSLYVVMATMLGPVLEHAIVTNYASVSLTAITNQAGILLSMDKGTPFWNLDWSVVLLCVGSWSGINGTTLMVASTMTVLHFAMILPGIRAKAAREAQNRTAAGVSKNPLIDGLNTINIQPLPEMDPMYERKMGLWMLIAVAGAAVVFDKRMLHYTEFGVLGSAAVSPLIEGYASAVWNTSVAASVCNLMRGHYMAGIPMAYSLIRNLSMKGVPRRGLQATHTLGMVWKHKLNAMDKAAFNAYRKDGVTEVDREPAREAMKKGDLVSGWAVSRGSAKLRWMHERGYIPLQGVVIDLGCGRGGWSYYAAAQRRVTAVKGLTKGGPGHEEPINVQSYGWNLVTFRSGVDVFHTEVQPADTLLCDIGESSADPAVEKARTVQVLVNFERWIRESRCEHFCCKVLGPYSPEVMERLDRLTKTYGGAVIRNPLSRNSTHEMYWVSGAKGNPVNAITATSRVLIERMYRRLGKSYWEEDVNLGTGTRAVSCAAEKPDLAKIGRRIELLKKEYKASWFEDPEHPYKTWTYHGSYETKTTGSSSSMINGVVKEITHPWDTNPRVTTVCMTDTTPFGQQRVFKEKVDTKAREPSQGTREIMRIVSKWLTLYIGRSKRPRLCTADEFIAKVNADAALGTMFDSQGNWANAKEAVRDPRFWQLVAKERELHLRGQCATCVYNMMGKREKKLTEFGKSKGSRAIWFMWLGARFLEFESLGFLNEDHWLSRENSGGGVEGIGLQYLGYVLKEMALIPGGKMYADDTAGWDTRITNADLEDEMDILGLMDPHHKKLAKNLMELAYNNKVVRVMRPGKGGKTLMDIISRKDQRGSGQVVTYPLNTWTNLKVQLIRMAESEGVLDPKEIDGITVTTRNNLEKWLTSQGAERLKRIAASGDDVVVKPVDERFANALTYLNDMAKIRKDISEWKPSAGWFHWEEVPFCSHHFHQLVLKDGRTLVVPCRDQDELIGRARVSPGAGWTIRETAGLSKAYAQMWLLMHFHRRDLRMAGFAICSAVPSDWVPTGRTSWSLHAKGEWMTTEDMLAVWNRVWIEDNPHMSNKTLVGSWQDIPYQRKSLDIHCGSMIGQRSRSTWAANIRISIGHVRRLIGTTEKYLDYMQEQERFKIAEPTRLGNVI

SEQ ID NO: 390 - DNA, 11830 bp, Artificial Sequence
  synthetic
ggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatctgggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctgcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgctctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaa

SEQ ID NO: 391 - protein, 3440 aa, Artificial Sequence
  synthetic
MVTKLRRPVKRAVDMMRRAVPRAAGPRRVLTRVSNTVKRNAGALRALLAYLLYQTFSGRKVGSGARSALKRFNKNDIVKMLLAFRRTLTNIITTMQRRVKGKKRRGVQDVPLLVLLLVGAGAMAAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSALSEIGCSLDISRKEMKCGDGVFIFREAGMWKDGYAFHPSEPKSLAASVLKSWQSGVCGVRSTNRMEHAMWKQIENELNGILEENEAQLSVVVRESNGTFPRGERRMHVAEPLRYGWKTWGKTAISTVPLAKETFVVDGNDEGECPSQMRAWNSFQVEEFGTGLVKTKVFLDISTALTAQCDTKMLGAAIKGNRSVHGDPGLWMVSAEIDGTWQIIELTLAESRRCTWPDSHTVWGRNVQESELILPPSFGGPMTNMNKRKGYATQVGGPWNHVPLRVVFEECPGTTVSVEPNCTRRSDSVRSTTDSGKIITDWCCRSCTMPPLTYRTPDGCWYAMEIRPKNVKEESLIRSHVAAGVFKGIDDVSLGLLVMIIFLQEGLRRKLTATYIMWAALVVLIAGILGELTVRDVLRYLILVGTAFAESNNGGDLIHLALVAVFKIRPAFLFGFLFRSQWSPREGVLLASGALMLQIASECLHASAIMQVVDSLSMGWLMIRAIAVPGMTSKAMPLLCACIPAVTSLLAHSTRAGIITMAGMSLIAGSKGSSVKKHSPYMLALVVAGLGARPIGMLAMEAFSHLKGRRSWPAGEMMSAVGLTCALVGAISGASSQDFAGPLAAAALIIIAYAISGRSADVYLEKAGEISWSEDAKISGSSPRIDVCVTENGDFKLRHESEATWTRNCVLAACLVVAGVHPLGIPVAGLMWFGYVKSNKRGTVLWDIPSPQATSAPTVEDGCYRVMSRRLLGSTQLGVGIMLDSTFHTMWHITRGASIVSGEGRLDPYWADVKEDLVCYGGPWKIRNTWDGLSEVQLIAVAPKENPVNVQTMPGKFIVANGGEIGAVVLDYPPGTSGSPIVDQQGNVIGLYGNGVMINDQTYASAIAQAPAEVARTPTWFTDDMLRKGQLHVLDLHPGAGKTRKVLPEILKAAVEKRLRTLVLAPTRVVAKEMHEALTGLPVRYQTSAVAPNGSGGELIDVMCHATYTHRQLTPGRGVNYQLYIVDEAHFTDPASIAARGIIATRVRLGHAAAIFMTATPPGMSNPFPESNAHIEDEEREVPTKAWNAGYEWITDYGGKTVWFVPSIRMANTIAACLVRAGKTVIVLHSGSFNEEYQKTKSGNWDFVVTTDISEMGANFKASRVIDSRLSIKPMFSYAPSERVVIGSPRAVSPASAAQRRGRVGRDPRQLGDQYIYGGPVGEDSAEFVHWKEARILMDNVTVPGGLYPQFYEPEGGMCDAMDGAHRLTDAKREVFRDLMKKGELPVWLAYQVAQAGHAYTDRTWCYGGPADHQVYDDCGQTVDYRSLNGERRMLRPKWLDQRTYNDKTSLRLFTEFAEGRRRYSELMDVFGRMPQHMLDRTILAADTFKDVLTATPGSRVHRLALDNLPEATETMMVVGILSVSTLGVMLFLMSPKGMTRMTCGLVVIILATYFLWVSGMAGYQIAAMQLIAFILFVVLVPEPGSQRSVQDNTIAIILIVILSLAAIIAANEAGLLEKTKKDFAWKRESHVLVTPSPWNLDFSMDLRPATSWSLYVVMATMLGPVLEHAIVTNYASVSLTAITNQAGILLSMDKGTPFWNLDWSVVLLCVGSWSGINGTTLMVASTMTVLHFAMILPGIRAKAAREAQNRTAAGVSKNPLIDGLNTINIQPLPEMDPMYERKMGLWMLIAVAGAAVVFDKRMLHYTEFGVLGSAAVSPLIEGYASAVWNTSVAASVCNLMRGHYMAGIPMAYSLIRNLSMKGVPRRGLQATHTLGMVWKHKLNAMDKAAFNAYRKDGVTEVDREPAREAMKKGDLVSGWAVSRGSAKLRWMHERGYIPLQGVVIDLGCGRGGWSYYAAAQRRVTAVKGLTKGGPGHEEPINVQSYGWNLVTFRSGVDVFHTEVQPADTLLCDIGESSADPAVEKARTVQVLVNFERWIRESRCEHFCCKVLGPYSPEVMERLDRLTKTYGGAVIRNPLSRNSTHEMYWVSGAKGNPVNAITATSRVLIERMYRRLGKSYWEEDVNLGTGTRAVSCAAEKPDLAKIGRRIELLKKEYKASWFEDPEHPYKTWTYHGSYETKTTGSSSSMINGVVKEITHPWDTNPRVTTVCMTDTTPFGQQRVFKEKVDTKAREPSQGTREIMRIVSKWLTLYIGRSKRPRLCTADEFIAKVNADAALGTMFDSQGNWANAKEAVRDPRFWQLVAKERELHLRGQCATCVYNMMGKREKKLTEFGKSKGSRAIWFMWLGARFLEFESLGFLNEDHWLSRENSGGGVEGIGLQYLGYVLKEMALIPGGKMYADDTAGWDTRITNADLEDEMDILGLMDPHHKKLAKNLMELAYNNKVVRVMRPGKGGKTLMDIISRKDQRGSGQVVTYPLNTWTNLKVQLIRMAESEGVLDPKEIDGITVTTRNNLEKWLTSQGAERLKRIAASGDDVVVKPVDERFANALTYLNDMAKIRKDISEWKPSAGWFHWEEVPFCSHHFHQLVLKDGRTLVVPCRDQDELIGRARVSPGAGWTIRETAGLSKAYAQMWLLMHFHRRDLRMAGFAICSAVPSDWVPTGRTSWSLHAKGEWMTTEDMLAVWNRVWIEDNPHMSNKTLVGSWQDIPYQRKSLDIHCGSMIGQRSRSTWAANIRISIGHVRRLIGTTEKYLDYMQEQERFKIAEPTRLGNV

SEQ ID NO: 392 - DNA, 11821 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctgccactttacgcaccgttggagacttgacatggctaaatgtgtcaaccactgatgttggaaagtggatacgtgtggagaataggcacggcaaaggagagtgtttcgtcacggccactgacgttggaacatggtgctcagactctgtgggatatgaatgtcctcaaattgcaccggcgtatgaccctgaagacttggattgctactgccgaaacacctcaacctacgttacttatggaaggtgtaaaaatgggcgcagtggacgatctcgcagcaagagagcaatcacgatagccccgcacggcgaagcaggattgcgtgttggaagcaccaagcattggacttctagagcaactccacaacggtatctaatgcgcgttgagaaatgggtgctgcggcatcctctacctgctctcgtgttggtggtactgggatggatgatgggtcgttctcacggccagagggccatgtatatagtgctgatgctgcttgtggctccgtcatatggtaaccaatgcctggatgtgcagtcacgtgatttcgtgcaaggggttagtggtggcacctgggtagatgttgttttggatcatgacaattgcataaccattgttgctgacgggaaaccatcttttgatattcgtttgtcgaaaatgagcatgtctaaattcgcagagtacaaacggtattgcctccaggccacgatgagtgatgtcactagcatagtggcgtgtccaggggctggggatgctcataatgacaagagcaaaaaccacgagtacatttgcaaagctgttaacaatgaccgcggatggggcaatgggtgtgtcctttttggcaaaggatcaatggaaacttgtggtaagtttgaatgtaagaagaaaatggctggcaagttagtggcacgtgagaacgtggaatcagtggtcactgtgcatgtacatggtgccactactgtggagtcgcacggaaactactccacacaggttggagccactcaggcagggaaagcgactatcacgccaaaagcttctgtggctactctaaatttaaacgactttggtagcctggaggtggattgttcaactgatgttggcatggactttggagagattgtggtggccgacatgtcaggaaagtggtggatcgtgaacaaggattggttcaatgaacttgctttgccgtggtccacggctagcaccactgctgaagtttggcaggcacgagacagacttgttgagtttggatggccacatgcggccaagcagaacatctatgacattggggaccaagaaggagctgtgacggctgccatagcccaggcacccatggcgaaatgggagtctgacaaggtcgagctaatctctgggattctcaagtgcaaggtgaaacttggcaacctaaagctgcgtggggtgacctatagcatgtgtgcccagacattcaccacggaaacaaggccggccgacaccggacatggcactgtggctttcaaggtgaaatacgtcggaacagacgtgccttgccgggtcccactccacatcatagacagtgacggcggagtggccgctggacgagtgataacggcacaccccttcgtcatgaagcagaatgattacattattctggaagttgaaccacccttcggtgacagcaaaattgagattggaacaggaacaacaaaactcgttgaagcatggcatcgaaaaggtagctcgataggaaatgcctttacggccacttacaagggcatcacaaaattgacagtgcttggagaacatgcctgggattttaattcactaggtgggtttggagcaagccttgggaaggcggtccatacactgtttggaggtgtattccgggtgatgttcggaggcatgggatggttaaccaagatctttgtgggtgctgtcctagtctggctaggattaggagctcatgacaagacgatcgccaccaccatgatcctggtaggatccatactgatgtacatggcagtgaccgtgggtgccctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaaggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatct

SEQ ID NO: 393 - protein, 3438 aa, Artificial Sequence
  synthetic
MVTKLRRPVKRAVDMMRRAVPRAAGPRRVLTRVSNTVKRNAGALRALLAYLLYQTFSGRKVGSGARSALKRFNKNDIVKMLLAFRRTLTNIITTMQRRVKGKKRRGVQDVPLLVLLLVGAGAMAATLRTVGDLTWLNVSTTDVGKWIRVENRHGKGECFVTATDVGTWCSDSVGYECPQIAPAYDPEDLDCYCRNTSTYVTYGRCKNGRSGRSRSKRAITIAPHGEAGLRVGSTKHWTSRATPQRYLMRVEKWVLRHPLPALVLVVLGWMMGRSHGQRAMYIVLMLLVAPSYGNQCLDVQSRDFVQGVSGGTWVDVVLDHDNCITIVADGKPSFDIRLSKMSMSKFAEYKRYCLQATMSDVTSIVACPGAGDAHNDKSKNHEYICKAVNNDRGWGNGCVLFGKGSMETCGKFECKKKMAGKLVARENVESVVTVHVHGATTVESHGNYSTQVGATQAGKATITPKASVATLNLNDFGSLEVDCSTDVGMDFGEIVVADMSGKWWIVNKDWFNELALPWSTASTTAEVWQARDRLVEFGWPHAAKQNIYDIGDQEGAVTAAIAQAPMAKWESDKVELISGILKCKVKLGNLKLRGVTYSMCAQTFTTETRPADTGHGTVAFKVKYVGTDVPCRVPLHIIDSDGGVAAGRVITAHPFVMKQNDYIILEVEPPFGDSKIEIGTGTTKLVEAWHRKGSSIGNAFTATYKGITKLTVLGEHAWDFNSLGGFGASLGKAVHTLFGGVFRVMFGGMGWLTKIFVGAVLVWLGLGAHDKTIATTMILVGSILMYMAVTVGALSEIGCSLDISRKEMKCGDGVFIFREAGMWKDGYAFHPSEPKSLAASVLKSWQSGVCGVRSTNRMEHAMWKQIENELNGILEENEAQLSVVVRESNGTFPRGERRMHVAEPLRYGWKTWGKTAISTVPLAKETFVVDGNDEGECPSQMRAWNSFQVEEFGTGLVKTKVFLDISTALTAQCDTKMLGAAIKGNRSVHGDPGLWMVSAEIDGTWQIIELTLAESRRCTWPDSHTVWGRNVQESELILPPSFGGPMTNMNKRKGYATQVGGPWNHVPLRVVFEECPGTTVSVEPNCTRRSDSVRSTTDSGKIITDWCCRSCTMPPLTYRTPDGCWYAMEIRPKNVKEESLIRSHVAAGVFKGIDDVSLGLLVMIIFLQEGLRRKLTATYIMWAALVVLIAGILGELTVRDVLRYLILVGTAFAESNNGGDLIHLALVAVFKIRPAFLFGFLFRSQWSPREGVLLASGALMLQIASECLHASAIMQVVDSLSMGWLMIRAIAVPGMTSKAMPLLCACIPAVTSLLAHSTRAGIITMAGMSLIAGSKGSSVKKHSPYMLALVVAGLGARPIGMLAMEAFSHLKGRRSWPAGEMMSAVGLTCALVGAISGASSQDFAGPLAAAALIIIAYAISGRSADVYLEKAGEISWSEDAKISGSSPRIDVCVTENGDFKLRHESEATWTRNCVLAACLVVAGVHPLGIPVAGLMWFGYVKSNKRGTVLWDIPSPQATSAPTVEDGCYRVMSRRLLGSTQLGVGIMLDSTFHTMWHITRGASIVSGEGRLDPYWADVKEDLVCYGGPWKIRNTWDGLSEVQLIAVAPKENPVNVQTMPGKFIVANGGEIGAVVLDYPPGTSGSPIVDQQGNVIGLYGNGVMINDQTYASAIAQAPAEVARTPTWFTDDMLRKGQLHVLDLHPGAGKTRKVLPEILKAAVEKRLRTLVLAPTRVVAKEMHEALTGLPVRYQTSAVAPNGSGGELIDVMCHATYTHRQLTPGRGVNYQLYIVDEAHFTDPASIAARGIIATRVRLGHAAAIFMTATPPGMSNPFPESNAHIEDEEREVPTKAWNAGYEWITDYGGKTVWFVPSIRMANTIAACLVRAGKTVIVLHSGSFNEEYQKTKSGNWDFVVTTDISEMGANFKASRVIDSRLSIKPMFSYAPSERVVIGSPRAVSPASAAQRRGRVGRDPRQLGDQYIYGGPVGEDSAEFVHWKEARILMDNVTVPGGLYPQFYEPEGGMCDAMDGAHRLTDAKREVFRDLMKKGELPVWLAYQVAQAGHAYTDRTWCYGGPADHQVYDDCGQTVDYRSLNGERRMLRPKWLDQRTYNDKTSLRLFTEFAEGRRRYSELMDVFGRMPQHMLDRTILAADTFKDVLTATPGSRVHRLALDNLPEATETMMVVGILSVSTLGVMLFLMSPKGMTRMTCGLVVIILATYFLWVSGMAGYQIAAMQLIAFILFVVLVPEPGSQRSVQDNTIAIILIVILSLAAIIAANEAGLLEKTKKDFAWKRESHVLVTPSPWNLDFSMDLRPATSWSLYVVMATMLGPVLEHAIVTNYASVSLTAITNQAGILLSMDKGTPFWNLDWSVVLLCVGSWSGINGTTLMVASTMTVLHFAMILPGIRAKAAREAQNRTAAGVSKNPLIDGLNTINIQPLPEMDPMYERKMGLWMLIAVAGAAVVFDKRMLHYTEFGVLGSAAVSPLIEGYASAVWNTSVAASVCNLMRGHYMAGIPMAYSLIRNLSMKGVPRRGLQATHTLGMVWKHKLNAMDKAAFNAYRKDGVTEVDREPAREAMKKGDLVSGWAVSRGSAKLRWMHERGYIPLQGVVIDLGCGRGGWSYYAAAQRRVTAVKGLTKGGPGHEEPINVQSYGWNLVTFRSGVDVFHTEVQPADTLLCDIGESSADPAVEKARTVQVLVNFERWIRESRCEHFCCKVLGPYSPEVMERLDRLTKTYGGAVIRNPLSRNSTHEMYWVSGAKGNPVNAITATSRVLIERMYRRLGKSYWEEDVNLGTGTRAVSCAAEKPDLAKIGRRIELLKKEYKASWFEDPEHPYKTWTYHGSYETKTTGSSSSMINGVVKEITHPWDTNPRVTTVCMTDTTPFGQQRVFKEKVDTKAREPSQGTREIMRIVSKWLTLYIGRSKRPRLCTADEFIAKVNADAALGTMFDSQGNWANAKEAVRDPRFWQLVAKERELHLRGQCATCVYNMMGKREKKLTEFGKSKGSRAIWFMWLGARFLEFESLGFLNEDHWLSRENSGGGVEGIGLQYLGYVLKEMALIPGGKMYADDTAGWDTRITNADLEDEMDILGLMDPHHKKLAKNLMELAYNNKVVRVMRPGKGGKTLMDIISRKDQRGSGQVVTYPLNTWTNLKVQLIRMAESEGVLDPKEIDGITVTTRNNLEKWLTSQGAERLKRIAASGDDVVVKPVDERFANALTYLNDMAKIRKDISEWKPSAGWFHWEEVPFCSHHFHQLVLKDGRTLVVPCRDQDELIGRARVSPGAGWTIRETAGLSKAYAQMWLLMHFHRRDLRMAGFAICSAVPSDWVPTGRTSWSLHAKGEWMTTEDMLAVWNRVWIEDNPHMSNKTLVGSWQDIPYQRKSLDIHCGSMIGQRSRSTWAANIRISIGHVRRLIGTTEKYLDYMQEQERFKIAEPTRLGNVI

SEQ ID NO: 394 - DNA, 11797 bp, Artificial Sequence
  synthetic
agtatattttgcgtgtgcgtttcaaaacacagattgtattgaaagtacgtaagagtataacacgttggaataaagttttggatcaagaggaaaatcatggttacaaaactcaggaggcccgttaaacgggccgtcgatatgatgaggcgcgcggtaccccgcgccgcaggaccccggcgggtcctaactagggtatcaaataccgtgaagcgtaacgcaggcgctcttagagctcttctggcttatctgctgtaccagacattctctgggcggaaagttggtagtggtgctcggagcgcccttaagcgcttcaacaaaaatgacattgtgaaaatgttgctggcgttcagacggacattgacaaacatcatcacaaccatgcagcgtcgtgtgaaaggaaagaaacgtcgtggcgttcaagatgtgccgctattggtcttgctgctcgttggagcaggagcgatggctttccatctgaccacccgagggggagagccgcacatgatagttagcaagcaggaaagaggaaagtcacttttgtttaagacctctgcaggtgtcaacatgtgtacccttattgcaatggatttgggagagttatgtgaagacacaatgacctacaaatgcccccggatcactgaaacggaaccagatgacgttgactgctggtgcaacgccacggagacatgggtgacttatggaacatgttctcaaactggtgaacaccgacgagacaaacgttccgtcgcactggcaccacacgtagggcttggtctagaaacaagaaccgaaacgtggatgtcctctgaaggcgcttggaaacaaatacaaaaagtggagacctgggctctgagacacccaggattcacggtgatagctctttttctagcacatgccataggaacatccatcacccagaaaggaattattttcattttgctgatgctggtaactccatccatggccatgcggtgcgtgggaataggcaacagagacttcgtggaaggactgtcaggagctacgtgggtggatgtggtactggagcatggaagttgtgttactaccatggcaaaagacaaaccaacactggatattgaactcttaaaaacggaggtcacaaacccagccgtcctgcgcaaactgtgcattgaagccaaaatatcaaataccaccaccgattcgagatgtccaacacaaggagaagccacgctggtggaagaacaagacacgaactttgtgtgtcgacgaacgttcgtggacagaggctggggcaatggttgtgggctattcggaaaaggcagcttaataacatgtgctaagtttaagtgtgtgacaaaactggaaggaaagatagtccaatatgaaaatttaaaatattcagtgatagtcaccgtccacactggagaccagcaccaagttggaaatgagactacagaacatggaacaactgcaaccataacacctcaagctcccacgtcggaaatacagctgacagactacggagctctaacactggactgttcacccagaacagggctagactttaatgagatggtgttgttgacaatgaaagaaaaatcatggctcgtccacaaacaatggtttctagacttaccgctgccttggacctcaggggcttcaacatcccaagagacttggaatagacaagacttgctggtcacattcaagacagctcatgcaaagaagcaggaagtagttgtactaggatcacaagaaggagcgatgcacactgcgttgactggagcgacagaaatccaaacgtctggaacgacaacaattttcgcaggacacctgaaatgcagactgaaaatggataaactgactttaaaaggggtatcatatgtaatgtgcacaggctcattcaagctagaaaaggaagtggctgagacccaacatggaaccgttctagtgcaggttaagtacgaaggaacagatgcaccatgtaagatccccttctcatcccaagatgagaggggagtaatccagaatgggagattgataacagccaaccccatagtcactgacaaagaaaaaccagttaacatcgaggcggagccaccttttggtgagagctacatcgtggtaggagcaggtgaaaaagctttgaaactaagctggttcaagaagggaagcagtatagggaaaatgtttgaagcaactgcccgtggagcacgaaggatggccatcctgggagacactgcatgggacttcggttctataggaggagtgttcacgtccgtgggaaaactggtacaccagatttttggaactgcgtatggagtcttgttcagcggtgtttcttggaccatgaaaataggaatagggattctgctgacatggctagggttaaattcaaggagcacatccctttcaatgacgtgtatcgcagttggcatggttacactgtacctaggagtcatggttcaggcgctatcggaaataggatgcagtctggacattagccgaaaagaaatgaagtgtggggacggagtcttcatcttcagagaggcaggcatgtggaaggatgggtatgcgttccacccttccgaacccaaatctctggccgcgtcagttctcaagagttggcagtctggagtgtgcggcgtgcgctccacgaacagaatggaacatgccatgtggaaacagattgaaaatgaattgaacggcattctagaagagaatgaggcgcaactcagcgtggttgtgcgagagtctaacgggaccttcccgagaggagagcgccgcatgcacgtggccgaacctctgcgctatggatggaagacctggggaaagaccgcaatttcgacggtgccgctcgctaaagaaacgtttgtggtagatggcaatgatgaaggagaatgtccctctcaaatgcgtgcttggaattccttccaagttgaagagttcggaactgggctggtgaaaaccaaagtgttcttggacatatccactgctctcaccgcccaatgtgacaccaaaatgctgggcgctgccataaaggggaataggtctgttcatggagatccaggtctctggatggtctcagctgaaatcgatgggacatggcagataatagagctcacattggcagagagcaggcgttgcacatggccagactctcacaccgtgtggggtaggaatgtccaggagagtgagttgatactgccaccgtctttcggaggaccgatgaccaacatgaacaagcgtaaaggctacgcgacccaagtgggaggaccatggaaccatgttccactacgagtagtttttgaagagtgtccgggaaccactgtatctgttgaaccaaactgcaccaggagatcggattcagtgcgatccacaactgatagcggcaagattataaccgactggtgttgtcgttcctgtacaatgcctcccctaacgtaccgaacccccgatggatgctggtatgcaatggaaatcaggcccaagaatgttaaagaggagagtctgatccgttcgcatgtggcggcaggtgtgtttaaaggcattgacgacgtgtcactggggctgttagtaatgataattttcctgcaggaaggtttgagaagaaagttaactgcaacgtatatcatgtgggctgctcttgtggtcctcattgcaggaatcctaggggaactcacagtgagggatgtgctcaggtatctcatcctagtcggcactgcattcgctgagagtaataatggaggagatttaatacatctggccctagtggcggtcttcaagattaggccggcattcttatttggattcttgttcaggagtcagtggtcccccagagaaggtgtgttgctggcatctggagcgctgatgctgcagattgcaagtgagtgcttgcacgcatcggcgattatgcaggttgtcgattccttgagcatggggtggttgatgatcagagccattgctgtacctggtatgacctcaaaagccatgccactgctgtgtgcctgcattcctgcagttacgagcctactggcccactcaaccagagccggtataatcaccatggccggcatgtcgcttattgcaggaagtaagggatcatcagttaaaaaacacagtccatacatgcttgccctcgtggtggcaggcctcggagcccgtcccataggaatgttggcgatggaagccttctctcacctgaagggccggagatcatggccggctggtgagatgatgtcagccgttgggctgacatgtgcgctagtgggagctatcagtggcgcatcatctcaggacttcgccggacctctagcagcagcggctctaattattattgcatatgccattagtggacgctcagctgatgtataccttgagaaagccggtgagatatcctggagtgaggacgctaaaatatccggatcaagcccgcgcattgatgtgtgcgttaccgaaaatggagatttcaaattgcgtcatgagagtgaagcaacctggacccggaattgtgtcttggctgcttgcttagtcgtagccggagtgcacccactggggattccagtagcagggttgatgtggtttggatatgtgaaatcaaacaagcgggggactgtgttgtgggacattccctcaccacaggcaacatcagctccaacggtggaagatggatgctaccgcgttatgtcacgtagactgcttggcagcactcagcttggtgttgggatcatgctagactctacatttcacacaatgtggcacataacccgaggagcatctattgttagtggtgaagggcgtcttgacccatattgggctgacgttaaggaagacctggtctgttacggagggccatggaaaatccgcaacacatgggatggactctcagaagttcagctgatagcggtggccccaaaagagaatcccgtgaacgtccaaacaatgccaggaaagttcattgtggcgaatggaggtgagataggagccgttgtgctcgactatcctcctggaacttctggttcacccatcgtggatcagcagggtaatgtcataggactgtatggcaacggggttatgatcaatgaccaaacgtatgcgagtgccattgcgcaagctccagctgaagttgcgcgcaccccaacctggttcactgatgatatgttgcgaaagggacaattgcatgtgctagacttgcaccctggagcgggaaaaacccgcaaggtcctgcctgagattctcaaagcagcggtggagaaacggctacgcacgttggtcctggccccaaccagagttgtggcaaaggaaatgcatgaagcattgaccgggctgccggtacgctaccagacatcagcagtggcaccaaatggttctggaggagaattgattgatgtcatgtgccatgcaacatacacacaccgccagctgacaccgggacggggggtcaactaccagttatacatagtggatgaggcacattttacagatcccgcttccatcgcagctcgcggcatcattgcgactagggtgcgattgggacatgccgcagcaatcttcatgacggccacacccccgggaatgtcaaacccattcccggagtctaatgctcacattgaagacgaagagcgggaggtacccaccaaagcttggaacgctggatatgagtggataacagactatgggggaaaaaccgtgtggttcgtgccttccatccggatggcgaacaccatagctgcatgcttggtacgagcaggcaagacagtcattgtactgcacagtggctctttcaatgaagaatatcaaaaaaccaagtctggcaattgggatttcgttgtgacgaccgacatctcagaaatgggggccaatttcaaagcctctagggtcatagactctagactgtccataaaaccgatgttttcctacgctcccagtgagcgagtggttattggctcacctagagcggtttctccagccagcgcagcacagcgccgagggagagtcgggagagaccctcgtcaactgggcgaccagtatatctatggtggaccagtaggagaagactcggccgagttcgttcattggaaggaagcaaggatcctcatggataatgtaactgtccctgggggcttgtatccacaattctacgaaccagagggtggaatgtgtgacgccatggatggagctcaccgactgaccgatgctaagagagaagtgttccgagacctcatgaagaaaggggaacttcctgtatggttagcataccaggtggcccaggctgggcatgcgtacactgacagaacttggtgctatggggggccggcggatcatcaagtgtatgatgattgcggccaaaccgtggattacaggtcccttaatggagagaggcgtatgctacgtcccaagtggcttgatcagcgcacctacaacgacaaaacatccttaaggctcttcacggaatttgcagagggacgccgccgatattcggaactaatggacgtgtttggaagaatgccccaacacatgttggacaggaccatcttggctgcagacacgtttaaagatgtcctgacagcaacaccgggatctcgtgtgcaccgtttagcactggacaatttacccgaagctacagaaactatgatggtagtgggaatcctgagtgtctcgaccctaggcgttatgctatttctgatgtcacccaagggcatgacccggatgacctgcggacttgtggtgatcatcctggcgacgtattttctatgggtgtcaggaatggccggctaccagatagcagcaatgcaactcatcgcgttcattctgtttgtggtcttggtgccagagccagggtcacagagatcagtgcaagacaacaccatagcgataattctcatagtcatcctgtcgttggctgccatcatagccgccaatgaagcaggattgctagagaagaccaaaaaggatttcgcgtggaagagggagagtcatgtgctggtgactccgagtccgtggaacctggatttctcaatggatttgaggccagccaccagctggtcattgtatgtggtgatggccaccatgttagggccagtactggaacacgccattgtcaccaattatgctagcgtctcacttactgccatcacaaaccaggcaggaatactgctgtcaatggataagggcactcctttctggaatcttgactggagtgttgtcctgttgtgcgtgggcagctggtcggggatcaatggcactacactaatggttgcttccacaatgacagttttgcattttgccatgatactacctggcattcgtgccaaagcggcgagagaagcacagaatcgaacagcagctggggtgtcaaagaaccctcttattgatgggttaaacaccataaacatccagccgttgccggaaatggaccccatgtacgaaaggaaaatggggctatggatgctaatcgctgttgccggagccgcggtggtttttgacaagagaatgctccattacaccgagttcggagtattgggttcagctgctgtgagtcctctcattgaaggatacgcgtctgctgtttggaacacttccgtagcagccagtgtgtgcaacctaatgcgaggccattacatggcgggaatcccaatggcatactctctgatcagaaatctatccatgaaaggagttcctaggaggggattacaggccacccatacccttggtatggtttggaaacacaaattaaacgccatggacaaggcggcctttaacgcataccggaaggatggagtgacagaagtggatagggagccagcacgtgaagctatgaagaaaggagatttggtgagcggatgggcggtctctcgagggtcagccaagctgcgatggatgcacgagcgtggatacattcccctacaaggagttgtcattgacctcggatgtggaagaggggggtggagttactacgctgctgcacaacgccgggtgaccgctgtcaaagggctcacgaaaggcggaccagggcatgaggagccaatcaacgtccagtcatatggatggaacttagtgacgttccgtagtggagtggatgtctttcacaccgaagtccagccggctgacaccctgttgtgcgacataggagagtcttctgctgaccccgctgtcgaaaaagcgcgcacagtacaagtgttggtgaactttgaaagatggattagagagtcgcggtgtgagcatttttgttgcaaggtgcttggtccctactctcccgaagtgatggagcgcttagatcgtttaacaaagacatatggaggagcggtaattcgcaacccactatccaggaactccacgcatgagatgtactgggtgtcaggagctaagggtaatccagtcaatgctataacagccacctcacgtgtgctaatcgaacgcatgtacagaagacttggcaagagttactgggaagaagatgtgaatcttggtactgggacccgtgcagtttcatgtgccgcggagaagccagatctagcaaaaatcggaaggcgcattgagttgctgaagaaggagtataaagcatcatggttcgaggatccagagcatccctacaagacatggacataccatggttcctacgaaaccaagaccacaggcagctcgtctagtatgattaatggcgttgtcaaggagatcactcacccttgggataccaacccaagggttacaaccgtctgtatgaccgacaccactccttttggacagcagagagtattcaaggaaaaggtagataccaaggcacgtgagccatctcaagggacgcgggagatcatgagaatagtgagcaagtggctcacactatatattggtcggagcaagcgccctaggctgtgcacagcggatgaattcatagccaaagttaatgctgatgccgctctcggcacgatgttcgactcgcagggaaactgggcgaacgccaaagaagctgtgcgcgacccacggttttggcagttggtggccaaagagagggaacttcacctgcgtggacagtgtgccacgtgtgtttacaacatgatggggaagcgagagaaaaagctgacagagtttgggaagtcgaaggggagccgagcaatttggtttatgtggctaggagctaggttcttggagtttgaaagtttaggcttcctaaacgaggatcattggttgtcacgtgaaaactcaggaggtggagttgagggcattggattgcaataccttgggtatgtgttgaaagaaatggcactaattcccgggggcaagatgtacgccgatgacaccgctgggtgggacaccagaattactaacgctgaccttgaggatgagatggacatattgggacttatggacccgcatcacaaaaaactggcaaaaaatctgatggagttggcgtacaacaacaaggtggtcagagtgatgcgccctggtaaagggggaaaaacactaatggacatcattagccgcaaggaccagcggggaagtggacaagtggtcacctacccactcaacacgtggacgaatctcaaggtccaattgatccgtatggcagagtcagagggagtgttggaccccaaggagatcgatggaatcactgtcacgactcggaataacctggaaaaatggctcactagccaaggggctgagcgtctaaagcgcattgcagctagcggtgacgacgttgtggtaaaaccagtggatgagagattcgccaatgctctcacctatctaaacgacatggccaaaattaggaaggacatcagtgagtggaaaccatccgcggggtggttccactgggaagaagtgccattctgctcacaccattttcaccagttggtcctcaaggatgggcgcaccttagtggtcccatgccgtgaccaggatgaactaattggaagggcaagagtgtcacctggtgctggatggactatcagagaaactgcaggtctaagcaaggcctatgcccagatgtggcttctaatgcacttccaccggagggacctcagaatggcaggtttcgccatttgtagtgctgtccccagtgattgggtgcccacgggaaggacatcgtggtcactgcacgctaaaggggagtggatgaccactgaagacatgttagcagtttggaacagagtgtggattgaagacaatccccacatgtctaacaagactttagtgggatcatggcaagacatcccgtaccagaggaaatccctggacatccactgtggctcaatgatagggcagcggtctaggtcaacatgggctgctaacatacgaattagcattggacacgtgcgccgattgattggaaccacggaaaagtacttggattacatgcaggagcaggagcggttcaagattgctgaaccaacccgtctgggcaatgtgatctaaggatctacgaacgagaataagtagaagaacggaacgacagagtcaggcctcaaatgagccagcattaatgagagtaagtgctgctgcctgtgcctctccttaacacgtggtagcgccactcgtgtttcgttacctaatagcgctagagtcagacccaagtaggccagggctatggttgtaagccctgctgtctgtggcagccatccagtggtaatgcgtcgcaccactaaggattaatagacgtatattgggagggactggtgaggagcagcaagctcgagctgcatcacccactggtactatcggttagaggaaaccccctccaaaatgtagagcatcatatcgacacctgggaaagaccggagatacctcttgcttcacagcactcaatccacaaggcacagatcgccgaataattgtggattggggattgagaaacatcaagtatctgggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaac

SEQ ID NO: 395 - protein, 3430 aa, Artificial Sequence
  synthetic
MVTKLRRPVKRAVDMMRRAVPRAAGPRRVLTRVSNTVKRNAGALRALLAYLLYQTFSGRKVGSGARSALKRFNKNDIVKMLLAFRRTLTNIITTMQRRVKGKKRRGVQDVPLLVLLLVGAGAMAFHLTTRGGEPHMIVSKQERGKSLLFKTSAGVNMCTLIAMDLGELCEDTMTYKCPRITETEPDDVDCWCNATETWVTYGTCSQTGEHRRDKRSVALAPHVGLGLETRTETWMSSEGAWKQIQKVETWALRHPGFTVIALFLAHAIGTSITQKGIIFILLMLVTPSMAMRCVGIGNRDFVEGLSGATWVDVVLEHGSCVTTMAKDKPTLDIELLKTEVTNPAVLRKLCIEAKISNTTTDSRCPTQGEATLVEEQDTNFVCRRTFVDRGWGNGCGLFGKGSLITCAKFKCVTKLEGKIVQYENLKYSVIVTVHTGDQHQVGNETTEHGTTATITPQAPTSEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGVSYVMCTGSFKLEKEVAETQHGTVLVQVKYEGTDAPCKIPFSSQDERGVIQNGRLITANPIVTDKEKPVNIEAEPPFGESYIVVGAGEKALKLSWFKKGSSIGKMFEATARGARRMAILGDTAWDFGSIGGVFTSVGKLVHQIFGTAYGVLFSGVSWTMKIGIGILLTWLGLNSRSTSLSMTCIAVGMVTLYLGVMVQALSEIGCSLDISRKEMKCGDGVFIFREAGMWKDGYAFHPSEPKSLAASVLKSWQSGVCGVRSTNRMEHAMWKQIENELNGILEENEAQLSVVVRESNGTFPRGERRMHVAEPLRYGWKTWGKTAISTVPLAKETFVVDGNDEGECPSQMRAWNSFQVEEFGTGLVKTKVFLDISTALTAQCDTKMLGAAIKGNRSVHGDPGLWMVSAEIDGTWQIIELTLAESRRCTWPDSHTVWGRNVQESELILPPSFGGPMTNMNKRKGYATQVGGPWNHVPLRVVFEECPGTTVSVEPNCTRRSDSVRSTTDSGKIITDWCCRSCTMPPLTYRTPDGCWYAMEIRPKNVKEESLIRSHVAAGVFKGIDDVSLGLLVMIIFLQEGLRRKLTATYIMWAALVVLIAGILGELTVRDVLRYLILVGTAFAESNNGGDLIHLALVAVFKIRPAFLFGFLFRSQWSPREGVLLASGALMLQIASECLHASAIMQVVDSLSMGWLMIRAIAVPGMTSKAMPLLCACIPAVTSLLAHSTRAGIITMAGMSLIAGSKGSSVKKHSPYMLALVVAGLGARPIGMLAMEAFSHLKGRRSWPAGEMMSAVGLTCALVGAISGASSQDFAGPLAAAALIIIAYAISGRSADVYLEKAGEISWSEDAKISGSSPRIDVCVTENGDFKLRHESEATWTRNCVLAACLVVAGVHPLGIPVAGLMWFGYVKSNKRGTVLWDIPSPQATSAPTVEDGCYRVMSRRLLGSTQLGVGIMLDSTFHTMWHITRGASIVSGEGRLDPYWADVKEDLVCYGGPWKIRNTWDGLSEVQLIAVAPKENPVNVQTMPGKFIVANGGEIGAVVLDYPPGTSGSPIVDQQGNVIGLYGNGVMINDQTYASAIAQAPAEVARTPTWFTDDMLRKGQLHVLDLHPGAGKTRKVLPEILKAAVEKRLRTLVLAPTRVVAKEMHEALTGLPVRYQTSAVAPNGSGGELIDVMCHATYTHRQLTPGRGVNYQLYIVDEAHFTDPASIAARGIIATRVRLGHAAAIFMTATPPGMSNPFPESNAHIEDEEREVPTKAWNAGYEWITDYGGKTVWFVPSIRMANTIAACLVRAGKTVIVLHSGSFNEEYQKTKSGNWDFVVTTDISEMGANFKASRVIDSRLSIKPMFSYAPSERVVIGSPRAVSPASAAQRRGRVGRDPRQLGDQYIYGGPVGEDSAEFVHWKEARILMDNVTVPGGLYPQFYEPEGGMCDAMDGAHRLTDAKREVFRDLMKKGELPVWLAYQVAQAGHAYTDRTWCYGGPADHQVYDDCGQTVDYRSLNGERRMLRPKWLDQRTYNDKTSLRLFTEFAEGRRRYSELMDVFGRMPQHMLDRTILAADTFKDVLTATPGSRVHRLALDNLPEATETMMVVGILSVSTLGVMLFLMSPKGMTRMTCGLVVIILATYFLWVSGMAGYQIAAMQLIAFILFVVLVPEPGSQRSVQDNTIAIILIVILSLAAIIAANEAGLLEKTKKDFAWKRESHVLVTPSPWNLDFSMDLRPATSWSLYVVMATMLGPVLEHAIVTNYASVSLTAITNQAGILLSMDKGTPFWNLDWSVVLLCVGSWSGINGTTLMVASTMTVLHFAMILPGIRAKAAREAQNRTAAGVSKNPLIDGLNTINIQPLPEMDPMYERKMGLWMLIAVAGAAVVFDKRMLHYTEFGVLGSAAVSPLIEGYASAVWNTSVAASVCNLMRGHYMAGIPMAYSLIRNLSMKGVPRRGLQATHTLGMVWKHKLNAMDKAAFNAYRKDGVTEVDREPAREAMKKGDLVSGWAVSRGSAKLRWMHERGYIPLQGVVIDLGCGRGGWSYYAAAQRRVTAVKGLTKGGPGHEEPINVQSYGWNLVTFRSGVDVFHTEVQPADTLLCDIGESSADPAVEKARTVQVLVNFERWIRESRCEHFCCKVLGPYSPEVMERLDRLTKTYGGAVIRNPLSRNSTHEMYWVSGAKGNPVNAITATSRVLIERMYRRLGKSYWEEDVNLGTGTRAVSCAAEKPDLAKIGRRIELLKKEYKASWFEDPEHPYKTWTYHGSYETKTTGSSSSMINGVVKEITHPWDTNPRVTTVCMTDTTPFGQQRVFKEKVDTKAREPSQGTREIMRIVSKWLTLYIGRSKRPRLCTADEFIAKVNADAALGTMFDSQGNWANAKEAVRDPRFWQLVAKERELHLRGQCATCVYNMMGKREKKLTEFGKSKGSRAIWFMWLGARFLEFESLGFLNEDHWLSRENSGGGVEGIGLQYLGYVLKEMALIPGGKMYADDTAGWDTRITNADLEDEMDILGLMDPHHKKLAKNLMELAYNNKVVRVMRPGKGGKTLMDIISRKDQRGSGQVVTYPLNTWTNLKVQLIRMAESEGVLDPKEIDGITVTTRNNLEKWLTSQGAERLKRIAASGDDVVVKPVDERFANALTYLNDMAKIRKDISEWKPSAGWFHWEEVPFCSHHFHQLVLKDGRTLVVPCRDQDELIGRARVSPGAGWTIRETAGLSKAYAQMWLLMHFHRRDLRMAGFAICSAVPSDWVPTGRTSWSLHAKGEWMTTEDMLAVWNRVWIEDNPHMSNKTLVGSWQDIPYQRKSLDIHCGSMIGQRSRSTWAANIRISIGHVRRLIGTTEKYLDYMQEQERFKIAEPTRLGNVI

SEQ ID NO: 396 - DNA, 11821 bp, Artificial Sequence; identical to SEQ ID NO: 392
  synthetic

SEQ ID NO: 397 - protein, 3433 aa, Artificial Sequence
  synthetic
MSKKPGGPGKSRAVNMLKRGMPRVLSLIGLKRAMLSLIDGKGPIRFVLALLAFFRFTAIAPTRAVLDRWRGVNKQTAMKHLLSFKKELGTLTSAINRRSSKQKKRGGKTGIAVMIGLIASVGAVTLSNFQGKVMMTVNATDVTDVITIPTAAGKNLCIVRAMDVGYMCDDTITYECPVLSAGNDPEDIDCWCTKSAVYVRYGRCTKTRHSRRSRRSLTVQTHGESTLANKKGAWMDSTKATRYLVKTESWILRNPGYALVAAVIGWMLGSNTMQRVVFVVLLLLVAPAYSFNCLGMSNRDFLEGVSGATWVDLVLEGDSCVTIMSKDKPTIDVKMMNMEAANLAEVRSYCYLATVSDLSTKAACPTMGEAHNDKRADPAFVCRQGVVDRGWGNGCGLFGKGSIDTCAKFACSTKAIGRTILKENIKYEVAIFVHGPTTVESHGNYSTQVGATQAGRLSITPAAPSYTLKLGEYGEVTVDCEPRSGIDTNAYYVMTVGTKTFLVHREWFMDLNLPWSSAGSTVWRNRETLMEFEEPHATKQSVIALGSQEGALHQALAGAIPVEFSSNTVKLTSGHLKCRVKMEKLQLKGTTYGVCSKAFKFLGTPADTGHGTVVLELQYTGTDGPCKVPISSVASLNDLTPVGRLVTVNPFVSVATANAKVLIELEPPFGDSYIVVGRGEQQINHHWHKSGSSIGKAFTTTLKGAQRLAALGDTAWDFGSVGGVFTSVGKAVHQVFGGAFRSLFGGMSWITQGLLGALLLWMGINARDRSIALTFLAVGGVLLFLSVNVHADTGCAIDISRQELRCGSGVFIHNDVEAWMDRYKYYPETPQGLAKIIQKAHKEGVCGLRSVSRLEHQMWEAVKDELNTLLKENGVDLSVVVEKQEGMYKSAPKRLTATTEKLEIGWKAWGKSILFAPELANNTFVVDGPETKECPTQNRAWNSLEVEDFGFGLTSTRMFLKVRESNTTECDSKIIGTAVKNNLAIHSDLSYWIESRLNDTWKLERAVLGEVKSCTWPETHTLWGDGILESDLIIPVTLAGPRSNHNRRPGYKTQNQGPWDEGRVEIDFDYCPGTTVTLSESCGHRGPATRTTTESGKLITDWCCRSCTLPPLRYQTDSGCWYGMEIRPQRHDEKTLVQSQVNAYNADMIDPFQLGLLVVFLATQEVLRKRWTAKISMPAILIALLVLVFGGITYTDVLRYVILVGAAFAESNSGGDVVHLALMATFKIQPVFMVASFLKARWTNQENILLMLAAVFFQMAYHDARQILLWEIPDVLNSLAVAWMILRAITFTTTSNVVVPLLALLTPGLRCLNLDVYRILLLMVGIGSLIREKRSAAAKKKGASLLCLALASTGLFNPMILAAGLIACDPNRKRGWPATEVMTAVGLMFAIVGGLAELDIDSMAIPMTIAGLMFAAFVISGKSTDMWIERTADISWESDAEITGSSERVDVRLDDDGNFQLMNDPGAPWKIWMLRMVCLAISAYTPWAILPSVVGFWITLQYTKRGGVLWDTPSPKEYKKGDTTTGVYRIMTRGLLGSYQAGAGVMVEGVFHTLWHTTKGAALMSGEGRLDPYWGSVKEDRLCYGGPWKLQHKWNGQDEVQMIVVEPGKNVKNVQTKPGVFKTPEGEIGAVTLDFPTGTSGSPIVDKNGDVIGLYGNGVIMPNGSYISAIVQGERMDEPIPAGFEPEMLRKKQITVLDLHPGAGKTRRILPQIIKEAINRRLRTAVLAPTRVVAAEMAEALRGLPIRYQTSAVPREHNGNEIVDVMCHATLTHRLMSPHRVPNYNLFVMDEAHFTDPASIAARGYISTKVELGEAAAIFMTATPPGTSDPFPESNSPISDLQTEIPDRAWNSGYEWITEYTGKTVWFVPSVKMGNEIALCLQRAGKKVVQLNRKSYETEYPKCKNDDWDFVITTDISEMGANFKASRVIDSRKSVKPTIITEGEGRVILGEPSAVTAASAAQRRGRIGRNPSQVGDEYCYGGHTNEDDSNFAHWTEARIMLDNINMPNGLIAQFYQPEREKVYTMDGEYRLRGEERKNFLELLRTADLPVWLAYKVAAAGVSYHDRRWCFDGPRTNTILEDNNEVEVITKLGERKILRPRWIDARVYSDHQALKAFKDFASGKRSQIGLIEVLGKMPEHFMGKTWEALDTMYVVATAEKGGRAHRMALEELPDALQTIALIALLSVMTMGVFFLLMQRKGIGKIGLGGAVLGVATFFCWMAEVPGTKIAGMLLLSLLLMIVLIPEPEKQRSQTDNQLAVFLICVMTLVSAVAANEMGWLDKTKSDISSLFGQRIEVKENFSMGEFLLDLRPATAWSLYAVTTAVLTPLLKHLITSDYINTSLTSINVQASALFTLARGFPFVDVGVSALLLAAGCWGQVTLTVTVTAATLLFCHYAYMVPGWQAEAMRSAQRRTAAGIMKNAVVDGIVATDVPELERTTPIMQKKVGQIMLILVSLAAVVVNPSVKTVREAGILITAAAVTLWENGASSVWNATTAIGLCHIMRGGWLSCLSITWTLIKNMEKPGLKRGGAKGRTLGEVWKERLNQMTKEEFTRYRKEAIIEVDRSAAKHARKEGNVTGGHPVSRGTAKLRWLVERRFLEPVGKVIDLGCGRGGWCYYMATQKRVQEVRGYTKGGPGHEEPQLVQSYGWNIVTMKSGVDVFYRPSECCDTLLCDIGESSSSAEVEEHRTIRVLEMVEDWLHRGPREFCVKVLCPYMPKVIEKMELLQRRYGGGLVRNPLSRNSTHEMYWVSRASGNVVHSVNMTSQVLLGRMEKRTWKGPQYEEDVNLGSGTRAVGKPLLNSDTSKIKNRIERLRREYSSTWHHDENHPYRTWNYHGSYDVKPTGSASSLVNGVVRLLSKPWDTITNVTTMAMTDTTPFGQQRVFKEKVDTKAPEPPEGVKYVLNETTNWLWAFLAREKRPRMCSREEFIRKVNSNAALGAMFEEQNQWRSAREAVEDPKFWEMVDEEREAHLRGECHTCIYNMMGKREKKPGEFGKAKGSRAIWFMWLGARFLEFEALGFLNEDHWLGRKNSGGGVEGLGLQKLGYILREVGTRPGGKIYADDTAGWDTRITRADLENEAKVLELLDGEHRRLARAIIELTYRHKVVKVMRPAADGRTVMDVISREDQRGSGQVVTYALNTFTNLAVQLVRMMEGEGVIGPDDVEKLTKGKGPKVRTWLFENGEERLSRMAVSGDDCVVKPLDDRFATSLHFLNAMSKVRKDIQEWKPSTGWYDWQQVPFCSNHFTELIMKDGRTLVVPCRGQDELVGRARISPGAGWNVRDTACLAKSYAQMWLLLYFHRRDLRLMANAICSAVPVNWVPTGRTTWSIHAGGEWMTTEDMLEVWNRVWIEENEWMEDKTPVEKWSDVPYSGKREDIWCGSLIGTRARATWAENIQVAINQVRAIIGDEKYVDYMSSLKRYEDTTLVEDTVL

SEQ ID NO: 398 - DNA, 11927 bp, Artificial Sequence
  synthetic
gcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaagacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtgatgcggttttggcagtacaccaatgggcgtggatagcggtttgactcacggggatttccaagtctccaccccattgacgtcaatgggagtttgttttggcaccaaaatcaacgggactttccaaaatgtcgtaacaactgcgatcgcccgccccgttgacgcaaatgggcggtaggcgtgtacggtgggaggtctatataagcagagctcgtttagtgaaccgagttttaaaagttaacccgtggttttaccctagtttcggtgaatttgccaattttacggaataactgtttgaaaggttcaaactctggtgtccaacgtttgtattaaaatgagtggattaggaggccttcttcccctccgagggaagaaaaagaaagcccctgtgatacaatcacagggcagggtcttgccgaagagcgactggaagggagctccgaaacaggatctaaataaaaagaaagcgaaaaaggacgagacgaaaggccagaattggccaagaagaattaacccccggactggacaatggtcggcaattgagggctctggtgctcggctgtggagaagcattttctctacagacttgatcggaggcttgttgttgttgatcgctattttatcaaatctctacgaaaaggttagacgtgacataacggaattgaaacgcagagtgactcgattggaaaaatctcgagctagtttgattttgaccccaatggtgttgctgtgtctggctatcctcgcggcaggcaagaccatgaatggaataatggacaagggtgagcacgtttggaaagctgactggaatgttgactttaccaatgtgaagctccccaaggacttctgcggatctggaatacacgtggagaagatgtgtcctcaggttgattctttgcaagatgcaacaatcgactgcgcaggaagacatgaccaatttctcctgtcctatacacgatgtgcggctaagaatcgtgtcaaacgtggtgaacccggagtagtggaaccgaaagtcacgaacatatggaccataacgttcaatgatgagttgaacagcatcattgaacgtgtgagcgggatgctgaagaacaatcgattgatggcaacagcagtcatttgcttagttggggctttcaagaaatggcctacatggctcgtcgtgcttttggttttactgccttggactgtcgtgcaggcagagtttgttgagccattcttggttttaaaacatgaccacagtactatgctcatgaccagactgtacccaggagaaatcgctcacgttgcaactcctgccgggttggtggacattcgtgttagccatgcccaaatttttggaggtcaacgctttcgtgagttactgagcgactgctctgtgaacgcttcgtattcgaccgacatatgccccggaggatcacaacttgacttggaatcgatcaaaggtcctggacgtgtctgcatgaccgctccgtacaatcgaggatggggaaccggatgtttcaaatggggaattggagctgttgccacgtgcgttgagttgaactgcacacgggaaacaaaagttgatttgttgacaaattctgctattgtggccaacgtgacagtcaatttccactcgaccaatgacactaaactccttgtgcctgacaccccaattacgttgaagtttgggaagttaggaacgatgacaatgacgtgtcgtttgggaaatgaccgcattgctaacgatttttaccatgtaactgacaatattgcatctggactgttccagaaagctttgattgatgcgtgggaaggaccctccaagatggcgaaccacattagcggacatgaaaaagtcgtgaagtggggtcacattctcccaaatgagatcaaggtcagcaagatcattgaaatggagttagattgggaaaaagcgatcaccacacatgatggattttcgaacacctatttttggtgtcaagtggccgtgaacaagttggtcgttgggtcatttgcctcatgcaagagcggagcgaaggctagcttcatccaatcctcgtggggttttgatggtgtggttgaagtgactttggatgaggccaccaaaaccatttgctccctacccctgacatgtaccggatgtagcttgttggctacaaaagtggttttccttgagggaagccagcgggctgttgggcacgtggggtgtggaaatggaacatcaatgttgacagtaggaacgacaaaggttgggatccaatgtgtggtcacaccggtgtcacaaatttggaacttcgtgactcacgcttccggacgatatgcgaaacttggttttggaggagttggaggagctttccatgatctgctagtgaaggttggattgaccttcacctgggattcatggaagatcatcaccgtgttgtctggtctcgtagtggcttttgccatctttgatcggaagttggtgatcctgatcattatcctctgtggaatcgcttatacccgagctgacattggatgtggcattgattttgacaggaagacctacacgtgtggaagcggtctattcgtgtggaagggtttgggaaaatacccaacggccgaccattctgttgagtttgcctcatatgattttctatcagcgtacctccaggagcagtttaagtctgagaagaaggtttgtattatttgtgaagacattgtccagtgtgaggcagctagaaaagcagccgctgcggtgtataaaaacctaggccacccgtttgtctacgtgaacacgtcggactcctatggaaaagtatttgccgaaatcccgaaaagagtccacactgttagtgtgggagtcgacgttgtggaaatggccatgatgactagggagaacaaaccggttggaccgtttggtgacttaccgcgtagtatggtttcgtggaagagtatccctgaaacagaagagcacccagtgttgagagtgttgacatcttcaagtgattaccagaaggtatgtggaaaagcgattggattccagtatgattttgttggataccgtcggaccatgtatggatctaatgtccagttaaaaatatcaaagaaggtttcgattgaatgtcccacatacttggcaggagtcgccgtgaaaaatgatagaacggttttcactgatggaatgttctggatgtcatcgaaacgtgagaatggaacatacgcgatcactgagttagagatggagcagtcccacaagtgcatctggccagaccaatacactcctgacgccactttgacgccacgtgacaatgaaatgtttgttccgcctgagtggggagggccaatgtcgaaagccaaccacattcctggttacaaaatgcagactggatttccatggaacaaagcccccattcggtttgttgagggaagtgttccaggaaccattgtcacacagattagccactgtgatggtagagggattgcagccgaagtgaatccagcaacgcagcccaattggtgctgtaagtcctgtacaaggattttccactttgaagtcgatgggaaactctattatccaatggagattcggcccgacccgaaaggaggggaacagcaaaaagttcctgtagtggagacacccattggagatgaagaaaccgagactgttggtggatggctgggtagaatgtataacattccaggagctgagggatcatatgcggattttcgactccccaagttgccaaattcaagaccaagcgcaatggtggggagtttggtcaatctattatgcttgatgttttcaattcagatagttaccaagactatgcgggcaagaacgcttatgcgtttctatctttgttgcttggtttttatgttctttggaatgccaactttgtttggattaagtgggtttttggcgtggatgatgattctaccaatctcacacaactcggtaacaatgtgcaacctaaccgtgcatctgtgggctgtactgctaaaccagagctcggcgatgtttctgtggggcctaacgctccgatcccagatacagaggtctaccgctggacagatgctactctttaccatgcagatgttgcatcacgccatctacgcgcactcttgggtgttcgggtgggtcatcgaagtatgcttgtcagtcgggcttatgatgaacttgttaaccgtcatcgatacggttcacccgaaactgatcgcatacttgctcttcttcggatggaaaacgggcatgtgcgtagtgtgcgcttggttattgatatactcaatcaggagatggaactctatagtcgccgcggctccggccgcgggcgggtggaggtcagggtatcgaacaatgatgtcctccagtttgattgttatctttatcagtgtaggaattgcaggagttatcgcttcggactatggaggttatccggctgcggctgcggtgactgcagcattgttgataatgggaatcaaaatgtttgactttctgacgacccgattgtctcttgagttcgtatctgcaggcatgttccccgaaggtgttgaaaaagcctttgaaccggactcggtcagtgacttgtttagggcatctttcactgtagatgggataaagttgcaggaccatgttgaaccgatccccattttgtttgccattttgtacatctttattggagctgtggcctgtaaggttaacccggccctcggaatagtgtatgctatcgccatgttcgcgactcctttaccggagttaatgcgtttatacatgatgaccatctattcctctacatttcggacagacactctgcttgggatggctatcccagaaacggagccagaactgtctcaagactttgggccaatccctgatgggatttatcgggtgaacaatcatggattttcagtgaagagtcatcggggagttggaatcgtaaagaatggggtttttcacactctcatgcatgtcacgctcaatgagccactcgcgtggcaaaatcgcctagtaggaccttcaatgggccactctctcaaggactatgtcacatacggtggaaactggcaattgcctgactttgatattgttaatgaggtgggcataatggtttgtggacgggatcgttccattcagtacaaaagacacgaggttgggacaatcatgatcgacgacaagcgagtgatgtacttcactcatgattacgggcacggatcatctggttcaccaatttttgtgaacggagaacctgtggccttatacggcttcgggttccatttgtacaataggtatcgatcaatagttctgcctatcccacgtgaagaagtccttgatggggctagtaatgagggcataccagctgagcacggaaccatgcgcaacaagttttttgttgactggcatccaggaaaagggaaaacccgaaaagtgatcgttaaagaggtgttaaatgctttgaatttagcacggcggattgttgttctggcccctacacgagttgtcctggctgaaataactaaggcaataggggaaaacacatcaaaaacgccctcaaaaaatcttgctttcaccggtcacaatattgtgacggtggcttgccacgcgacgttcactgattatgttttgcgtcatgggttatcaaaattcaaagctcacgaagtcataatggatgagtgccattttctggacccacgatctatagctgcgagaggaatcctggagcatctggcaactaaacgtggagttaaagtcacgtttatgagtgcaacgatcccaggacgtgaaccttcactcgggtcgaattttgagatctctgaacaggccttgcagtttccccgtgacgtcaaccaaaggtggatagaaactgttgctaggggaaagaccgttgccttcgtgccatctcacagggtaggtgacaagctagctcgcgggtgtccccaagccatttccctgcataggaacaattttgacaccaattacagcacagctatggatgagtccataaaatttatctacaccactgacatatcggaaatgggagccaatttcagtgctgacaccgtcatagatttccgggtggcgattaagccaaagatttctagtgaatttgccgtcactcttgaaccaactccgatcacgcgatcatcgatgattcaacggcgtggtcgagttggaagacaacgacctggaacctatatttacccagttgacaaaggcgtcgaagatgcctccgatcagttggcttgttggacagaagctcagatgttgttggatcaattggacttgacaatgatggcagaggaagttcggcagtcaaacattccaggggcttacaaattagttgggcgtagcctagacatatttcggaagttgctggagaaggatgacataccaatctggctgagctggaagtgggccgacagtgttcaacaacaatactccatattgtttgaaggagaacgtcaagagaatgtcgctcgtgtcgtcaacactcgagactatgcttctctagagtataagccgaagtttgttgatgcacgattcgagcgtcttggatgggatcaacgaaagctgtcaattcagttttacatgaacactcggagcttcataactttcgccactttgtcacacgtcatttctcaagtgatcgaagctggagttgtcaattctgcttggaagcgaataggagacgttagcatcatctttactgaaggaggcgacccacatgctaaagatgaaactatcatggcttggactattctggttggaggagtgttgggggctcttggattcctcatagttgcatggggaatgaaggctgtcttgcgagtaattttcggatcccgcgataagcatcttagcgtcccaaccttagtggcggatttccaaccatacatagtgtgtatagttcccattgccctacatcttgctggggttcctataccaatgacaattgtgtttttcgcgatgcttttcttgacttatccactaatgtacaagagtgccggacaacggagttatgttgacattgacttggtgaaatggattctgttaggtggatgtattgtaactggagtcatttgctgggaaatgagattgctcccaaacatctcatcagacatttcagctattttgaataggcaaagacaaagggaagacaccccaacttttgatgcttcaccaccttgggaatggttggatttagcacagccagtccctcacaatgttgaattgacgtcagtggtgataactacattcacgacctggctgttcttgcaccaaattgtcggatggtcatacgagtcagagtggctgaaatcctatttcgaccacaaaggagtgggtcagatcatgggtggttttcggttggacacaatttcatggggatcagctctaagcggtcttctgggcacagctacttatgcctcatggggagccattttgactgggttaggaggagcggttgtgtattttttcctgatggtttcaatgctcaagtggaacttttcgggaggagccacaactggcttagaaaacaatgtcatgcgaaacgaccgagaaactggactaggtaatcggccggcaaacgacaataggcgttccctcctgtacggtgtggtggcggctgaatgtcttgtgtggttgttctgtttcagaactgccacggatgccatagtggtggcttgtttagtgtcctattgtttatggatcatcaacaacccggctagccctcaccacaaaaacactgacttaggatcggcgtgtagtttcatcggtcttttgtactgtacatgtcctactcaaaaatgcatccaagtattgatgaggtttgctttggccaggttgaacatgaacacccgctctctggaaaaaagcgcgacgggaggccttggacaccgttggaagaagctattaaatgcgatgacactattggaattcaacgcttaccgatcttgtggagttgacgagactgagaagggtgactatgtgtcacgaggagggctgaagctgagagagataaccatgaagtatggttggaagccagaagggatatgtgttgatcttggatgcggcagaggaggatggtcacagcacttggctatggatccccgcgtaactagagtggaatcattcacgttaggaggaacagcacgagaaaatccccagccaatcaagacacttggtcataaccttatccggttcaagagtggagtcaatgtgtataatatgacgccaacacatgctaacaccatagtgtgtgatatcggagaaagtgaccccaaaccagaggtggaaacctctagaacattgcgggtcctcaaaacacttgaactatggttggccaggaatccaaacgctgaatttgtgtgcaaagtcctttgcccataccccgtggaagtcctcaaatgtctggaaacccttcaacataagtatggcggaagaattattaggtcgacgtatagccgaaattcaagtgctgaaatgtattacatttctggaggccgtaacaacatggtgaaggttatcttcaccaccctccactccttgatttcgaggatacgaactaggccggagaaaatcgtcaaagaaagtgtttctctaccagttgggactagaagcgatccagggcacaagatcaagagtatggatccaaagatgatagcaacgcgggtggaaaagataaaaaaggaacatgcggacacgtggttcgttgacaacaaccatccataccaatcatttcggtatgtgggatcgtacgtcacagatgatgtgacaccaggaggtcagactgtcaacccattaatgagaaaaatgatgtggccgtgggagactgttggaggagttgtaaatttcatgatgacggacgtgtccacatatgcccaacagaaggtgttgcgagagaaggtcgacacactatcccctgaacctccaaacgacattcaaagggttaacagatggatcaccgagttcttgtgtgcttcattcatgcgtcgagggttgaaacctagaatcctgaccatggagcaatatatcaacaacgtaaagagctcagctgccattggatcgtggagcagtgatgtcccgtggagcagtgtccgagaagctttagctgataaaagattccaccaaatggtcgaggaggaaaggaaactccacttagcaggagactgccgcatgtgcgtgtacaacaccatgggcaagaaggagaagaaaccttcagccatgggcgtggccaagggctctcgaaccatttggtacatgtggttaggttcacggtttttggagtacgaagcccttggcttcttaaatgaagatcattgggtgtcacgagacaacttggcatgtggtgttggtggagtgggagtgaattacttcggctactacctacaagaaattgcacggaaagggaagttttttatcgccgatgacatagcgggatgggacacgcggatcaatgagagtgacttggccgatgaggaatttctcatcatgtccctcatttgtgacccataccatcgatcacttgcaaaagccgtgtttcggtttgcctaccagaacattgtggccttgtttccgcgaaatcatcctgggtttggaagtggaacggtgatggatgtcgtggccagaactgaccaacgaggttcaggacaggtcgtgacttacgctctaaacacgataacgaacgccaagattcaattaggcagaatgctggaagccgaaggattactagacgctcatgaacatgtaatcaaaaaatggttaaacgacaatggtgaagaggctctctccgggatggtggtggccggggatgatgttgtagttgcgaccaacaacggaaatttttcaaggtccttacgatacctccatttgaacgggaaaattcgtaaagacattgatccgtccctaccgtccaaagttgaaacgaactgggaggtggttgaattttgttctcaccattaccacgtgatgaccttaaaggacggacgacgaataattgtcccatgccgagagcagaatgaaatcattggacgaggcaggattcaaaaaggagggttggtgacccttgccgaaagtgcctgcctagcgaaggcttatgggcaaatgtgggctttgtatttctttcaccgaagagatctgcggatggcttttctagccataacttcgagtgttccaatagactggttcccagagggccggacctcgtggtcgattcaccaaaataaagagtggatgaccactgaggacatgttgcgggtctggaatacagtgtggatccaggacaatccctggatggaggacaaaatggaaatcgaaaattggagggacattccgtacctcccgaaatccatggacctaaagtgcggcagtctcattggaacaaaagaaagagccgcttggtcaaaggatctgccgtcaacggtcacggcagttcggaaaattatcgaccaagacacgaaaaccgagaatgtctaccaagactttcttggcggaatgggccggttccaaacgtacactgaccccatggcaacgtaagaaaccatcttttccaaattagtcgaaaaattttgcccctcttcgaggggctttggcggcagcaggagattttctccggggtttcacgctccccccgatgccagtggtcacagcccaagtcagagacttggagttgtggcgggacagtgagctctgtcagtggtcaatagctcaataaatatggcagcagagcttgtctcggggattcacgctccccccattgtgagtgtgtcgaactggtttcgaaggacgtctagaacgacgctaaagttcaaatccggcaacagagagtttatgtctcggggcctcacgcaccccccgttgtgagtgaagtcctttctggccatttagtggtcaggaagggtaccgttttggaacgacggaaataagttccatggagcgacactagccccactgaggggcggttggaatgacacccaacccgctatagtgcgtcgacaggtcaattagctacctggaataagctaatgtgcagggcaacaaagttctaacgaactagggtgagtagcgtcaccccccggttgtgaaaacgattgcgactagaactaaagtcgagagtctccccaccgataggggagctcgtcagtttgttttagtccaattacgctgggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggg

SEQ ID NO: 399 - DNA, 11696 bp, Artificial Sequence
  synthetic
gggtcggcatggcatctccacctcctcgcggtccgacctgggcatccgaaggaggacgtcgtccactcggatggctaagggagagccacttttctctcgattctctatcggaatctagggagctcggatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgctcgagggggggcccggtaccttgaagctgtccctgatggtcgtcatctacctgcctggacagcatggcctgcaacgcgggcatcccgatgccgccggaagcgagaagaatcataatggggaaggccatccagcctcgcgtcggcgcttaaggatcatgatgataaacaatgtatggtgctaatgttgcttcaacaacaattctgttgaactgtgttttcatgtttgccaacaagcacctttatactcggtggcctccccaccaccaacttttttgcactgcaaaaaaacacgcttttgcacgcgggcccatacatagtacaaactctacgtttcgtagactattttacataaatagtctacaccgttgtatacgctccaaatacactaccacacattgaacctttttgcagtgcaaaaaagtacgtgtcggcagtcacgtaggccggccttatcgggtcgcgtcctgtcacgtacgaatcacattatcggaccggacgagtgttgtcttatcgtgacaggacgccagcttcctgtgttgctaaccgcagccggacgcaactccttatcggaacaggacgcgcctccatatcagccgcgcgttatctcatgcgcgtgaccggacacgaggcgcccgtcccgcttatcgcgcctataaatacagcccgcaacgatctggtaaacagttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccggaaagatgaaaagtctaatgggagaattgggctttggatggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggaaagaccatgaatggaataatggacaagggtgagcacgtttggaaagctgactggaatgttgactttaccaatgtgaagctccccaaggacttctgcggatctggaatacacgtggagaagatgtgtcctcaggttgattctttgcaagatgcaacaatcgactgcgcaggaagacatgaccaatttctcctgtcctatacacgatgtgcggctaagaatcgtgtcaaacgtggtgaacccggagtagtggaaccgaaagtcacgaacatatggaccataacgttcaatgatgagttgaacagcatcattgaacgtgtgagcgggatgctgaagaacaatcgattgatggcaacagcagtcatttgcttagttggggctttcaagaaatggcctacatggctcgtcgtgcttttggttttactgccttggactgtcgtgcaggcatcactggccgatcctttcttaattctgccgaagggtgatggtttggtaaaaactagattatacccaggacagatttcatcaatttccacacacgttggggtactggacatctcttatatggctgtggacattgaggaggggcgactcgttgaaaggttgatgtcacattgcgaagtaaatggaacttactcacaggattgttgcgctttgggatgcaacttggacttatctaagttaaatgagcggaacagggcctgtcaaacggctacctacaatcgcgggtgggctacgggatgtccagtttttggactgggcagtgtggccacatgcgttgaggtcgcgtgcagcgatagtgtggaggtgtccgaactgacaagccagaacatccggattcctctatctctacgtttgcagcatgaagagctgaatgtgaccatgacaacagaggcgccagttacttcaaagttctcacatcacggggtggtatccatctcttgtcaaattggcaatcctgggttcttggcacagcagtacgtgctgagcaatgggaagcataaagcaatgtttcccatcagtgcggtatcaggttggcctggaatccgtgagattggtggacagtacaggaacgtggatggctccgtcaagtgggggcacgttgaagcgaatgagattaaggtggccgctgtatatagtgacagcatccaatggaagactggaatcccgataaagacaggtattagagacccactgtatttgtactgtgaagtgtcgctaactgacttgactttcaagaaaataagagcatgtgaatcgcctgttgaagtttcgttcatggcaggacctacgggtttggatggtcgrctagaaattgggttgcttgagcaagtcaacaaaacatgctcaataacagggagctgtgaaggttgtaccttaccgcacccaaccagtgtcatttcgacttctgacaagaaaggccacatgcacgtagaatgtcgcacggggacatttacggcaatattcggaaagcaaaaattttctttcacctgtcrracwagttacctcagaactatttgggctacgactgcccaggcgattggaaattataggaaattcggactggatgcctcaggaggaccatttttggacttatggaataagataggtccaaatttctcccgtttggaggttgttggaatccttgttgtggcagccttgttaattgacaaaagactcttacttctcctggctatttttggatacgtcacatacgtgcgagctgacttcggatgtggatttgacccagataggaaggtagcacagtgtggttctggctcattcgtgtggaagtcactggcccgttggccaatggctgatcacgctattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaaggtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacggctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtacacaatagacctagcaacacccacggacaagaggcttttcatgccgccacaatacggaggaccaatttcgtttgcgaaccacgtgcctggattccaggtgcaagaggactttccctggcagaaggcgaatatattaatgcgccagggaccggttccgggaacgaccgtagtccaggatccacactgtgatgaccggagcgcggcagtgccagttgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagattcaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgattacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgaccatcattatggacgagtgccactttctggacccgatgtccatcgcgtgccgcgggataatggatttccacaacagccgtggaacgaaggtcatcttcatgagtgcgacgcccccaggacgagcaggaaacgctgggtccaactttacaatagaagacagagccatcaagttccccaaggagttgaccgcatcgtggatcaaagacaagtcaataggcaagaccatcgtttttgtgccaacaattacgcaagctgtgaggctggctaaagagttgggaggggtggccttgacccgagatacgttcaatgatgccatggggaaggcccggagtccggaaacaatgtttataatctcaacagacatcagcgagatgggagccaatctcggagtgactactgttatcgacacaagaactgttataaaaccattagtgtctgacaaaggagtttcacttgaaagggttggtgtgaccccagcttcaatcatccagcgcaggggccgagtaggtcggcgggagcccggagtatacatttatccccttgacgtcgaaccagaggagcagccggaaaattgggtgtgttgggtggaggcgcaaatgatcttagatcaattgggctgccatccgatgagagaggagagcgaatttttccgcccacaaggcacgtaccggattgacgacgtagagcagcggaggtttctggggttgatcaaggaaaaactgccaatttggcttgcttggacttgggccagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactatacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcgtgggaacctcgaggagttgtcgttgacctgggatgtggacgaggaggttggtcccagcgcttggtgatggattaccgcgtcgctgaagtaagaggatacacacttggaggcaaagaacgtgagaatccccaaccgttccaaacgaaaggatataacttggcgaatttgaaggctggagttgacgtctataaaatggagccagtgaattgtaacaccataatttgcgacataggtgagagtgacccgcgtcctgaagttgaaaaaactcgaacgctgaaggttttgggaatgctggagaaatggctggaagtcaatccaaacgcctctttttgctgcaaagtgctatcaccttatcacttggacgtgcttcgaaagttagagtcgctgcaacacaagtataacgggcggctggttcgactgtcttacagtcggaactcaacagcagaaatgtattatgtgtcaggaaagagggcaaacgtggtggcaagcgtgtacttcatgcttgggtcgctggtaggtaggctgcggagacatgagccatcaatcatcgaccccccaccggttctagagatgggaaccagaagcgatccgcgagcaaaggccaaagcgcaagacttcgagatgatccgaagaagagtggaacgactacgaggagaaaatcggaaaacatggtttgtggacaacgaacatccatatgtgtcatttaactaccatggatccttcgtgactgatgaggtgacagcgggcggacaaacaacaaatcccttgattagacgcgttatgtggccatgggactttctgtctcgggtgacaacctttatgatgaccgatgtttcaacgtatgcccaacaaaaggtgctgcgtgaaaaagtggacactgtctctgaggagcccgacgagcgaatgaaagcaattaacagactcatcatgacacacttcgtgaaaatgttcaagcggcgcgggctgaaaccgagggtgttgacaccacaagactacatgaataatgtccaagccaacgcagccataggaggatggagcgaagtaatggattggcaaaacgtgcgcgatgctttggcagatcaacgattctgggacatggtagataacgagagggccttacacttgcgtggtgactgtgagctttgcatctataacacgatgggaaagaaagaaaagaagccatctgcctttggcactgcgaaaggttcacgcaccatctggtatatgtggctgggtagccgttatttagagtacgaggctttaggattcttgaacgaagatcattgggttgcacgagaaaactttccatgtggagtcggtggcgtcggcgttaactattttggatattacctgaaggaaatagccgggggaggccggtggcttatcgcagacgatgtcgcgggatgggacacgagaataacccaaggagatctagatgatgagctgttcatgttaaccgagcttgccccaaccacataccacaagaaattgataactgcgacaatgacgttggcttataaaaacatagtggccttattccctagaaatcatccgatgtaccgaagtggaactgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggagcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggcaggatatcatggtctatccaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaagagccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 400 - DNA, 11032 bp, Artificial Sequence
  synthetic
  misc_feature (151)..(151): n is a, c, g, or t
agttttaaaaaacttttgcgttagtaaaaccacggagttttggtttgctgagaatagtgcgagggttgttttaattatttcggagattttggttcgtgatgaatcaggagagaggaatacycaggggtatggggaggttcccccccccccntgtgaagaaggggaacaagaattctgttgccgtggccagggtgccaccgcagcaaggaggaaaagcgagagagaaaaaccgtgagaggattaaagcgccaggagcgcgacatggagttgccggraagatgaaaagyctaatgggagaattgggctttggatggattgatttactacgcgttgatttggtggaaggaattatgatgatggkttttgttatacagcgggctttcgcccaagtgcaccggagaattagaggattatcaagacgcgtcagggcattggagaagaagcgtgacggtcgagcggctatgttcatttggactatattggcaatgttattcggagttatgggagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgctgacttcggatgtggatttgacccagataggaaggtagcacagtgtggttctggctcattcgtgtggaagtcactggcccgctggccaatggctgatcacgcyattgagtttgaagatagcaaagtgatggtgacttacttgactgacctattgatgagaaagaacaaagtctgcatagtgtgtgaagatgtrttgcartgtgcygcagcgcgtggagttgtcgagcarataacgtcgatcaatggaatcccaatccatcacaacatgtcgctgtcgcatggccgatatttyccacgtgtagtgaagaaagtacacaatgttaaggtgggaaaagccatgttgcgycttgcaatggccacatatgcgggagcgatgcctgaragtggattgggtgttttgaagacggggtatttttcacgcggagaagtgcaggaaacgtgggatgataaagttctaagagtcctaaccagcgccataaatgcrgaggaagtgtgccagacggctgtcackttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaacccaaagccaccaatgcatttggccatacgcgtayacaatagacctagcaacacccacggacaagaggctyttcatgccgccacaatacggaggaccaatttcgtttgcgaaccatgtgcctggattccaggtgcaagaggactttccctggcagaaggcgaatatattaatgcgccagggaccggttccgggaacgaccgtagtccaggatccacactgtgatgaccgaagtgcggcagtgccagtcgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccgttaccaatgggagaaacagccaagatccaaaattttttcgtgaccagcccgccaaagccggaatcaagcctgcttttggtgggcgttctgattcatatgttaacaacgcgaacccgccatcggtgggcaactcgttgtgctggaacttggctcatctttttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgatcacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacytgytkcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagcyttggaacttgtgcgcctaccgggacaaagyctgccagacggatgtgaagaagaagcrtcaacatcyctaccagamggaatgagtgggcattacgccccygatggagttgaactcgtgaactacacagatgcaggractgtctccgcaaaccttgtggtrtttgttgggtgtgctggaattatgacyatgaacatatacgttgggttggttatcacggccttggcctgggtaacggacgccccgatgtggattccragattgattgatggygctatgtcccagcgggcaaattcggagctattgctgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgactatcattatggacgagtgccactttctggacccgatgtccatcgcgtgccgcgggataatggatttccacaatagccgtggaacgaaggtcatcttcatgagtgcgacgcccccaggacgagcaggaaacgctgggtccaactttacgatagaagacagagccattaagttccccaaggagttgaccgcatcgtggatcaaagagaagtcaataggcaagaccatcgtttttgtgccaacaattacgcaagctgtgaggctggctaaagagctgggaggggtggccttgacccgagatacgttcaatgatgccatggggaaggcccggagtccggaaacaatgtttataatctcaacagacattagcgagatgggagccaacctcggagtgactactgttatcgacacaagaactgttataaaaccattagtatctgacaaaggagtttcacttgaaagggttggtgtgaccccagcttcaatcatccagcgcaggggtcgagttggtcgacgagagcccggagtatacatttatccccttgacgtcgaaccagaggagcagccagaaaattgggtgtgttgggtggaggcgcaaatgatcctagatcaattgggctgccatccgatgagagaggagagcgaatttttccgcccgcaaggcacgtaccggattgacgacgttgagcagcggaggtttctcgggttgatcaaggaaaaactgccaatttggcttgcttggacttgggctagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactayacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggcggatgcgttttgttatggtatgttttaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcatgggaaccccgaggagttgtcgttgacctaggatgtgggcgaggaggctggtcccagcgcttggtgatggattaccgcgtcgctgaagtaagaggatacactcttggaggcaaagaacgtgagaatccccaaccgttccaaacgaaaggatacaacttggcgaatttgaaggctggagttgacgtctacaaaatggagccagtgaattgcaacaccattatttgcgacataggtgagagtgacccacgccctgaagttgaaaagacacgaacgctgaaggttttgggaatgctrgagaaatggytggaagtcaatccaaacgcctctttttgctgcaaagtgctrtcrccttatcacttggacgtgcttcgaaagttagagtcgctgcaacacaagtataayggrcggctggttcgaytgtcttacagtcggaactcaacagcagaaatgtattaygtgtcaggaaagagrgcaaacgtggtggcaagcgtgtacttcatgctygggtcgctggtaggtaggctgcggagacatgagccatcaatcatcgaccccccrccrgttctagagatgggaaccagaagcgatccgcgrgcaaaggcsaaagcgcaagacttcgagatgatccgaagragagtrgaacgaytacgaggagaaaaycggaaaacatggtttgtrgacaacgaacatccatatgtgtcattyaactaccatggatccttcgtgactgatgaggtgacagcgggcggacaaacracaaatcccttgattagacgcgtyatgtggccatgggactttctgtctcgggtgacaacctttatgatgaccgatgtttcaacgtaygcccaacaaaaggtgctgcgygaaaargtggacactgtctctgaggagcccgacgagcgaatgaaagcaattaacagrctyatcatgacacacttcgtraaaatgttcaagcggcgcgggytgaaaccgagggtgttgacaccacaagactacatgaataatgtccaagccaacgcagccataggaggatggagcgaagtgatggattggcaaaacgtgcgcgatgctttggcagatcaacgattttgggacatggtagataacgagagagccttacacttgcgtggtgactgtgagctttgcatttataacacgatgggaaagaaggaaaagaagccatctgcctttggcactgcgaaaggttcacgcaccatctggtatatgtggcttggaagccgttatttagagtacgaggctttaggattcttgaacgaagatcattgggttgcacgagaaaactttccatgtggagtcggtggcgtcggtgttaattattttggatattatctgaaggaaatagccgagggaggccgatggttaatcgcagacgacgtcgcgggatgggacacgagaataacccaaggagatctagatgacgagctgttcatgttaactgagcttgccccaaccacataccacaagaaattgataactgcgacaatgacgttggcttataaaaacatagtggccttattccctagaaatcatccgatgtaccgaagtggaaccgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggakcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggtaggatatcatggtctattcaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccaygtcgatcctgtgttcaactgaagtgtgacgatgtaggcccgcgggagccttagaattcaagagcttgggaattctagaatcccgtttaccgcaggagggggtcatatggagcaggtggctatgtatagcctggctaaatgtatggctcctgggggagtgacgcccctccggttccagttcctgggtgaacaggtaaaaaccaccacgaagcgccgcttcaacatcgcaagggggagaaatcccgggtgctgacgccaccccgaccccagtcccacataaggctgtgacgaaaragccttaccggcacgaggagtgcccaccgcaaggaggagaaatcctgggcgttgacgacgccccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 401 - DNA, 11032 bp, Artificial Sequence
  synthetic
agttttaaaaaacttttgcgttagtaaaaccacggagttttggtttgctgagaatagtgcgagggttgttttaattatttcggagattttggttcgtgatgaatcaggagagaggaatactcaggggtatggggaggttcccccccccccctgtgaagaaggggaacaagaattctgttgccgtggccagggtgccaccgcagcaaggaggaaaagcgagagagaaaaaccgtgagaggattaaagcgccaggagcgcgacatggagttgccgggaagatgaaaagcctaatgggagaattgggctttggctggattgatttactacgcgttgatttggtggaaggaattatgatgatggtttttgttatacagcgggctttcgcccaagtgcaccggagaattagaggattatcaagacgcgtcagggcattggagaagaagcgtgacggtcgagcggctatgttcatttggactatattggcaatgttattcggagttatgggagcggaggtcactagacgtgggagtgcatactatatgtacttggacagaaacgatgctggggaggccatatcttttccaaccacattggggatgaataagtgttatatacagatcatggatcttggacacatgtgtgatgccaccatgagctatgaatgccctatgctggatgagggggtggaaccagatgacgtcgattgttggtgcaacacgacgtcaacttgggttgtgtacggaacctgccatcacaaaaaaggtgaagcacggagatctagaagagctgtgacgctcccctcccattccactaggaagctgcaaacgcggtcgcaaacctggttggaatcaagagaatacacaaagcacttgattagagtcgaaaattggatattcaggaaccctggcttcgcgttagcagcagctgccatcgcttggcttttgggaagctcaacgagccaaaaagtcatatacttggtcatgatactgctgattgccccggcatacagcatcaggtgcataggagtcagcaatagggactttgtggaaggtatgtcaggtgggacttgggttgatgttgtcttggaacatggaggttgtgtcaccgtaatggcacaggacaaaccgactgtcgacatagagctggttacaacaacagtcagcaacatggcggaggtaagatcctactgctatgaggcatcaatatcagacatggcttcggacagccgctgcccaacacaaggtgaagcctaccttgacaagcaatcagacactcaatatgtctgcaaaagaacgttagtggacagaggctggggaaatggatgtggactttttggcaaagggagcctggtgacatgcgctaagtttgcatgctccaagaaaatgaccgggaagagcatccagccagagaatctggagtaccggataatgctgtcagttcatggctcccagcacagtgggatgatcgttaatgacacaggacatgaaactgatgagaatagagcgaaggttgagataacgcccaattcaccaagagccgaagccaccctggggggttttggaagcctaggacttgattgtgaaccgaggacaggccttgacttttcagatttgtattacttgactatgaataacaagcactggttggtccacaaggagtggttccacgacattccattaccttggcacgctggggcagacaccggaactccacactggaacaacaaagaagcactggtagagttcaaggacgcacatgccaaaaggcaaactgtcgtggttctagggagtcaagaaggagcagttcacacggcccttgctggagctctggaggctgagatggatggtgcaaagggaaggctgtcctctggccacttgaaatgtcgcctgaaaatggataaacttagattgaagggcgtgtcatactccttgtgtaccgcagcgttcacattcaccaagatcccggctgaaacactgcacgggacagtcacagtggaggtacagtacgcagggacagatggaccttgcaaggttccagctcagatggcggtggacatgcaaactctgaccccagttgggaggttgataaccgctaaccccgtaatcactgaaagcactgagaactctaagatgatgctggaacttgatccaccatttggggactcttacattgtcataggagtcggggagaagaagatcacccaccactggcacaggagtggcagcaccattggaaaagcatttgaagccactgtgagaggtgccaagagaatggcagtcttgggagacacagcctgggactttggatcagttggaggcgctctcaactcattgggcaagggcatccatcaaatttttggagcagctttcaaatcattgtttggaggaatgtcctggttctcacaaatcctcattggaacgttgctgatgtggttgggtctgaacacaaagaatggatctatttcccttatgtgcttggccttagggggagtgttgatcttcttatccacagccgtctctgctgacttcggatgtggatttgacccagataggaaggtagcacagtgtggttctggctcattcgtgtggaagtcactggcccgttggccaatggctgatcacgccattgagtttgaagatagcaaagtgatggtgacttacttgactgacctattgatgagaaagaacaaagtctgcatagtgtgtgaagatgtattgcagtgtgccgcagcgcgtggagttgtcgagcagataacgtcgatcaatggaatcccaatccatcacaacatgtcgctgtcgcatggccgatatttcccacgtgtagtgaagaaagtacacaatgttaatgtgggaaaagccatgttgcgccttgcaatggccacatatgcgggagcgatgcctgagagtggattgggtgttttgaagacggggtatttttcacgcggagaagtgcaggaaacgtgggatgataaagttctaagagtcctaaccagcgccataaatgcagaggaagtgtgccagacagctgtcacgttccagtatgagttcgttcgatataaccggaaagtctttggatctaacatcgtgttgcgaccttcagcctttacgagcaaagcttgcccaacatatttagctggggctgtggtcaaaaacgacatagcaacgtttacggacggaatgatgtggatgcggagccggaaagtcaatgaaacgtgggaactgtttgagttggaaacaactcaaagccaccaatgcatttggccatacgcgtacacaatagacctagcaacacccacggacaagaggcttttcatgccgccacaatacggaggaccaatttcgtttgcgaaccatgtgcctggattccaggtgcaagaggactttccctggcagaaggcgaatatattaatgcgccagggaccggttccgggaacgaccgtagtccaggatccacactgtgatgaccgaagtgcggcagtgccagtcgaaccaactatgcaagcttggtgctgcaagacctgttttgatagaggagtgaagcctttccattttgtggttgacgggaaatttttctatccaatggaagtgcggccaatgaaactggaacaagacgctgtggtgattgagactgatgatggagagttcgagaggagtgagcatgagagcttgtttgaaggcaaagcaaagtggacatcaccattgccaatgggagaaacagccaagatccaaaattttttcgtgaccagcccgccaaagccggaatcaagcctgcttctggtgggcgttctgattcatatgttaacaacgcgaacccgccatcggtgggcagctcgttgtgctggaacttggctcatcttcttggtctttggacatccggttgtgtcttcggtgcagtcttgggcgtggctctttatgtcagctgccttagcaagtgtccctggtggttcttcactggtgatccacttctggattgggttgcagatatcgtcagcgcacctcttttacctgggttggttaatgaggaaacgcctgttgatcacagagatgtcgcgagtggcacatctgattgcccagttgtgcagcttcgagacatatgcgtgggcaccgatcctcaaagtactggatcacttgctgtttccactctacactctgtcagtattcgtcgttcaccagcagtttcaggtattccacgacttgtggctacagagcgccgtggtgatggcacacctgttgcaacaccctctcagtggtttaataaccttgagtttaagcgtcggcttgattcagctaatagcaccaatgaaaagatggttttgctcaccagttatatggggagatggcttacgcgcgccgagaccacactggacagccttaacgtatttcatcgtgctgtatttggcagccgctgggatggagacagtgggtctgcacacgtccgggatgacagtgatgctgggcgggatgcttctgtgggttgtcctacagttgatgcccccgacagccttggaacttgtgcgcctaccgggacaaagtctgccagacggatgtgaagaagaagcgtcaacatctctaccagaaggaatgagtgggcattacgcccccgatggagttgaactcgtgaactacacagatgcagggactgtctccgcaaaccttgtggtatttgttgggtgtgctggaattatgactatgaacatatacgttgggttggttatcacggccttggcctgggtaacggacgccccgatgtggattccaagattgattgatggtgctatgtcccagcgggcaaattcggagttattactgccatccccacctcttgagatacacaagacggaagactcgtttggttacatcccggacggaacatatcacgtgttggctagcagctggatgagcaagaaaccagttggtgttggagtggtgaaggagggcgtgtttcacacgttacaccacgtcaccaaaggagctaatgtgacatgggcaggacgtgaggttaggatgcactctggagatgttaggcgggatattgctgcctatggcgggccctggaacatcagcgggagtcttgaagatgtcgtagtagtgaaggccgtgaacaaggatggaaccgtgacatgctgccggattacaacagctaagttggacattgaaggaactacagtgatggctgttgagcgagattttggtttcggctcttcggggtcccccatatacgctcctgatggacggttgattggcttgtatggatacgggttttactatggaacgtacttctcaatagtttcaacaggagaaggagtggaggcaccaccggaagaggttgaagtctcaacacgtgagtttgtggactggcaccctggaagaggaaaaacgcgcacgatactcgttgagcaggccctgaagcatatagctgatggaaagaggttgctaattttgacaccaacgcgggtcgtaaaggatgaagtgcagcgagcgataaaggaagccgccccgcaggcggttatcggatcgaacttaagcatttttcggaagaacgccgttaccttggcatgccacgcgaccttcacgcagtatgtgatggagaaggggatagaaagtgtgaagttttcgactatcattatggacgagtgccactttctggacccgatgtccatcgcgtgccgcgggataatggatttccacaatagccgtggaacgaaggtcatcttcatgagtgcgacgcccccaggacgagcaggaaacgctgggtccaactttacgatagaagacagagccattaagttccccaaggagttgaccgcatcgtggatcaaagagaagtcaataggcaagaccatcgtttttgtgccaacaattacgcaagctgtgaggctggctaaagagctgggaggggtggccttgacccgagatacgttcaatgatgccatggggaaggcccggagtccggaaacaatgtttataatctcaacagacattagcgagatgggagccaacctcggagtgactactgttatcgacacaagaactgttataaaaccattagtatctgacaaaggagtttcacttgaaagggttggtgtgaccccagcttcaatcatccagcgcaggggtcgagttggtcgacgagagcccggagtatacatttatccccttgacgtcgaaccagaggagcagccagaaaattgggtgtgttgggtggaggcgcaaatgatcctagatcaattgggctgccatccgatgagagaggagagcgaatttttccgcccgcaaggcacgtaccggattgacgacgttgagcagcggaggtttctcgggttgatcaaggaaaaactgccaatttggcttgcttggacttgggctagctcacatgcgaacaaacatcagatgctatttcagggaaacgcccccaacactggacgaacattaaaaataaagacgccatccggatctcacatttacgccccaaaggtgacagatgataggtttgaaaaggagccagaaattgtgaaagtggcggccatcggattcttcctaaagcagagatcactacacttcgacttacctggattattgaccggattgtacacggtgttgacaacggctgggctcgatgcccttggaaattcgttcaaacgctctgtggacacccttcacgacatcggaaatgcggtggaaggagagttttctgctatacaaatgggacggattttacagatgtggtctgcgttgtttatcggggtgactttgggagttgtgctgatgggagccggatttgttgtggtgaaggcttttagaggattgtttggaacccgccaacaacacacaactgtgtgcgtgtcggagggcggaagtttccaaaaagttgccacggttctaatgagcgttggaccattgtgcgccgtttttggtggcattccctctatattcgtcttcattgtgaccgttgccctgttgattgtgctgtgtgtgggcggaggtggctctcaacgtggtgtgcttgattcggatctaatacgctgggtcatggtgttggccatgatgacaatcggagtgactgcgtgggagttggagctattaccaaacgtgagaagagatgttatacagttgactcgatacctgtttgctagcaatcctgccgttgttggagctgtgtttaacgccgggaatatcggattgggagtctctctgccagggaccctcatgatgagctacgccgcgagcggaacgctggccccccttattggagcgtgggccgaaggaaatttcttaggaaagctctttggtagcgaagtgcttccagctcaggctataggcggatttcaagtgacagctatcccgtggggatctatggtgccggttatcgctggttgctttctagcgacaaacactctttcgaaagtgtttggtgctggaattacaactgtgtttctcatactactctacttcgacaagaaacatgcattcacgaacaaggctgttaaggttttgttggcgcggacaaacagaagggacatggaggaagaaatcacaacaagggacgcggagtcgcgggctcgccaactgttttatggcctacaactggccgtatcgttgctgtgggttctctcacatcctgtgttggaaaacttcgttccattctttgctgtgtgcgggtacacattcctgtcgctcttgaggccaaatcatcaactacatgctgcgttggattatacattggtagtcctgctcttgcaggtagttgaacctgggaacatcatgtacgtcggyggatgcgttttgytatggtatgttytaaaccctaccagattgggcgtgcgctcgctggtgaagagtgacaccggaggtttaggcttccgttggaagaaagcgttgaattcacttagtgagaggcagtttgccatctacaaagtcagaggcgtgaatgaaactgataaaggagcctacgtgtcgcgaggtggtttaaaaatgaacgagattatcaacaagcatgcatgggaaccccgaggagttgtcgttgacctaggatgtgggcgaggaggctggtcccagcgcttggtgatggattaccgcgtcgctgaagtaagaggatacactcttggaggcaaagaacgtgagaatccccaaccgttccaaacgaaaggatacaacttggcgaatttgaaggctggagttgacgtctacaaaatggagccagtgaattgcaacaccattatttgcgacataggtgagagtgacccacgccctgaagttgaaaagacacgaacgctgaaggttttgggaatgctagagaaatggttggaagtcaatccaaacgcctctttttgctgcaaagtgctgtcgccttatcacttggacgtgcttcgaaagttagagtcgctgcaacacaagtataatggacggctggttcgattgtcttacagtcggaactcaacagcagaaatgtattacgtgtcaggaaagagagcaaacgtggtggcaagcgtgtacttcatgctcgggtcgctggtaggtaggctgcggagacatgagccatcaatcatcgaccccccgccagttctagagatgggaaccagaagcgatccgcgggcaaaggcgaaagcgcaagacttcgagatgatccgaaggagagtagaacgattacgaggagaaaaccggaaaacatggtttgtagacaacgaacatccatatgtgtcattcaactaccatggatccttcgtgactgatgaggtgacagcgggcggacaaacgacaaatcccttgattagacgcgtcatgtggccatgggactttctgtctcgggtgacaacctttatgatgaccgatgtttcaacgtacgcccaacaaaaggtgctgcgtgaaaaggtggacactgtctctgaggagcccgacgagcgaatgaaagcaattaacaggcttatcatgacacacttcgtaaaaatgttcaagcggcgcgggctgaaaccgagggtgttgacaccacaagactacatgaataatgtccaagccaacgcagccataggaggatggagcgaagtgatggattggcaaaacgtgcgcgatgctttggcagatcaacgattttgggacatggtagataacgagagagccttacacttgcgtggtgactgtgagctttgcatttataacacgatgggaaagaaggaaaagaagccatctgcctttggcactgcgaaaggttcacgcaccatctggtatatgtggcttggaagccgttatttagagtacgaggctttaggattcttgaacgaagatcattgggttgcacgagaaaactttccatgtggagtcggtggcgtcggtgttaattattttggatattatctgaaggaaatagccgagggaggccgatggttaatcgcagacgacgtcgcgggatgggacacgagaataacccaaggagatctagatgacgagctgttcatgttaactgagcttgccccaaccacataccacaagaaattgataactgcgacaatgacgttggcttataaaaacatagtggccttattccctagaaatcatccgatgtaccgaagtggaaccgttcttgatgtgttgtctcgaacggatcagcgtgggtcgggccaggtgacaacatacgctttgaacactgtgactaatggaaagtgccaggtcgggagaacattagaagcgtgtggcttgctggacgccccgctcaccacaatcgactcctggctcactgccaacttggaacgagttcttggatcaatggtcgttgccggagatgatgtggtagtggcgacagacaatgaagaattccacacgagtttgagatacataacagcgacgtcaaagatccgaaagaacttaggggtgagtgagccatcgccgagattcacgagctgggaagatgttgagttttgctcacaccacttccatccactgacgttacgtgatggccgtgtgctgatcgccccgtgtcgtgaccaaaacgaaattatcggaagatcaagaatccagaaaggcggaatagttgacatggcctcggctgggtgcttagcgaaggctcacgcgcagatgtgggccctttacttcttccatcggcgagacttacggattggattcgcggccatcacatcaattgtgcctatcaactgggtgccgacgggtaggatatcatggtctattcaccagaacgcagagtggatgacgactgaggatatgctaacggtttggaacaacgtgtggattagggacaatccgtggatgagaggaaaagaacgagtgacttcatggacagacataccgtatttacccaaaggagtggacataaagtgcggaagcctaataggcgattccgaccgcgcttcctggtcaaagacgattcccctagttgtggagaagacccgaaaaatccttgagcaggagaggggaacattgaagttctacaatgggttatccattctaggacggtatgttcaccacgtcgatcctgtgttcaactgaagtgtgacgaygtaggcccgcgggagccttagaattcaagwgcttggraattctagaatcccgtttaccgcaggagggggtcatatggagcaggtggctatgtatagcctggctaaatgtatggctcctgggggagtracgcccctccggttccagttcctgggtgaacaggtaaaaaccaccacgaagcgccgcttcaacatcgcaagggggagaaatcccgggtgctgacgccaccccgaccccagtcccacataaggctgtgacgaaaragccttaccggcacgaggagtgcccaccgcaaggaggagaaatcctgggcgttgacgacgcyccggccccagtctctgataggtgaccagaaccatgtcaccccaaagtgttgaaaggacactgatcaccagaaatggtgagggcacacagggcttagcccaaggtgagtgacgacacctcccgaaatgtgtaaatagcagggtcagctctaagcagcaggcttccaccgttaggaagcgttgctgtgagcttacttggctacgtct

SEQ ID NO: 402 - protein, 3385 aa, Artificial Sequence
  synthetic
MSGLGGLLPLRGKKKKAPVIQSQGRVLPKSDWKGAPKQDLNKKKAKKDETKGQNWPRRINPRTGQWSAIEGSGARLWRSIFSTDLIGGLLLLIAILSNLYEKVRRDITELKRRVTRLEKSRASLILTPMVLLCLAILAAGKTMNGIMDKGEHVWKADWNVDFTNVKLPKDFCGSGIHVEKMCPQVDSLQDATIDCAGRHDQFLLSYTRCAAKNRVKRGEPGVVEPKVTNIWTITFNDELNSIIERVSGMLKNNRLMATAVICLVGAFKKWPTWLVVLLVLLPWTVVQAEFVEPFLVLKHDHSTMLMTRLYPGEIAHVATPAGLVDIRVSHAQIFGGQRFRELLSDCSVNASYSTDICPGGSQLDLESIKGPGRVCMTAPYNRGWGTGCFKWGIGAVATCVELNCTRETKVDLLTNSAIVANVTVNFHSTNDTKLLVPDTPITLKFGKLGTMTMTCRLGNDRIANDFYHVTDNIASGLFQKALIDAWEGPSKMANHISGHEKVVKWGHILPNEIKVSKIIEMELDWEKAITTHDGFSNTYFWCQVAVNKLVVGSFASCKSGAKASFIQSSWGFDGVVEVTLDEATKTICSLPLTCTGCSLLATKVVFLEGSQRAVGHVGCGNGTSMLTVGTTKVGIQCVVTPVSQIWNFVTHASGRYAKLGFGGVGGAFHDLLVKVGLTFTWDSWKIITVLSGLVVAFAIFDRKLVILIIILCGIAYTRADIGCGIDFDRKTYTCGSGLFVWKGLGKYPTADHSVEFASYDFLSAYLQEQFKSEKKVCIICEDIVQCEAARKAAAAVYKNLGHPFVYVNTSDSYGKVFAEIPKRVHTVSVGVDVVEMAMMTRENKPVGPFGDLPRSMVSWKSIPETEEHPVLRVLTSSSDYQKVCGKAIGFQYDFVGYRRTMYGSNVQLKISKKVSIECPTYLAGVAVKNDRTVFTDGMFWMSSKRENGTYAITELEMEQSHKCIWPDQYTPDATLTPRDNEMFVPPEWGGPMSKANHIPGYKMQTGFPWNKAPIRFVEGSVPGTIVTQISHCDGRGIAAEVNPATQPNWCCKSCTRIFHFEVDGKLYYPMEIRPDPKGGEQQKVPVVETPIGDEETETVGGWLGRMYNIPGAEGSYADFRLPKLPNSRPSAMVGSLVNLLCLMFSIQIVTKTMRARTLMRFYLCCLVFMFFGMPTLFGLSGFLAWMMILPISHNSVTMCNLTVHLWAVLLNQSSAMFLWGLTLRSQIQRSTAGQMLLFTMQMLHHAIYAHSWVFGWVIEVCLSVGLMMNLLTVIDTVHPKLIAYLLFFGWKTGMCVVCAWLLIYSIRRWNSIVAAAPAAGGWRSGYRTMMSSSLIVIFISVGIAGVIASDYGGYPAAAAVTAALLIMGIKMFDFLTTRLSLEFVSAGMFPEGVEKAFEPDSVSDLFRASFTVDGIKLQDHVEPIPILFAILYIFIGAVACKVNPALGIVYAIAMFATPLPELMRLYMMTIYSSTFRTDTLLGMAIPETEPELSQDFGPIPDGIYRVNNHGFSVKSHRGVGIVKNGVFHTLMHVTLNEPLAWQNRLVGPSMGHSLKDYVTYGGNWQLPDFDIVNEVGIMVCGRDRSIQYKRHEVGTIMIDDKRVMYFTHDYGHGSSGSPIFVNGEPVALYGFGFHLYNRYRSIVLPIPREEVLDGASNEGIPAEHGTMRNKFFVDWHPGKGKTRKVIVKEVLNALNLARRIVVLAPTRVVLAEITKAIGENTSKTPSKNLAFTGHNIVTVACHATFTDYVLRHGLSKFKAHEVIMDECHFLDPRSIAARGILEHLATKRGVKVTFMSATIPGREPSLGSNFEISEQALQFPRDVNQRWIETVARGKTVAFVPSHRVGDKLARGCPQAISLHRNNFDTNYSTAMDESIKFIYTTDISEMGANFSADTVIDFRVAIKPKISSEFAVTLEPTPITRSSMIQRRGRVGRQRPGTYIYPVDKGVEDASDQLACWTEAQMLLDQLDLTMMAEEVRQSNIPGAYKLVGRSLDIFRKLLEKDDIPIWLSWKWADSVQQQYSILFEGERQENVARVVNTRDYASLEYKPKFVDARFERLGWDQRKLSIQFYMNTRSFITFATLSHVISQVIEAGVVNSAWKRIGDVSIIFTEGGDPHAKDETIMAWTILVGGVLGALGFLIVAWGMKAVLRVIFGSRDKHLSVPTLVADFQPYIVCIVPIALHLAGVPIPMTIVFFAMLFLTYPLMYKSAGQRSYVDIDLVKWILLGGCIVTGVICWEMRLLPNISSDISAILNRQRQREDTPTFDASPPWEWLDLAQPVPHNVELTSVVITTFTTWLFLHQIVGWSYESEWLKSYFDHKGVGQIMGGFRLDTISWGSALSGLLGTATYASWGAILTGLGGAVVYFFLMVSMLKWNFSGGATTGLENNVMRNDRETGLGNRPANDNRRSLLYGVVAAECLVWLFCFRTATDAIVVACLVSYCLWIINNPASPHHKNTDLGSACSFIGLLYCTCPTQKCIQVLMRFALARLNMNTRSLEKSATGGLGHRWKKLLNAMTLLEFNAYRSCGVDETEKGDYVSRGGLKLREITMKYGWKPEGICVDLGCGRGGWSQHLAMDPRVTRVESFTLGGTARENPQPIKTLGHNLIRFKSGVNVYNMTPTHANTIVCDIGESDPKPEVETSRTLRVLKTLELWLARNPNAEFVCKVLCPYPVEVLKCLETLQHKYGGRIIRSTYSRNSSAEMYYISGGRNNMVKVIFTTLHSLISRIRTRPEKIVKESVSLPVGTRSDPGHKIKSMDPKMIATRVEKIKKEHADTWFVDNNHPYQSFRYVGSYVTDDVTPGGQTVNPLMRKMMWPWETVGGVVNFMMTDVSTYAQQKVLREKVDTLSPEPPNDIQRVNRWITEFLCASFMRRGLKPRILTMEQYINNVKSSAAIGSWSSDVPWSSVREALADKRFHQMVEEERKLHLAGDCRMCVYNTMGKKEKKPSAMGVAKGSRTIWYMWLGSRFLEYEALGFLNEDHWVSRDNLACGVGGVGVNYFGYYLQEIARKGKFFIADDIAGWDTRINESDLADEEFLIMSLICDPYHRSLAKAVFRFAYQNIVALFPRNHPGFGSGTVMDVVARTDQRGSGQVVTYALNTITNAKIQLGRMLEAEGLLDAHEHVIKKWLNDNGEEALSGMVVAGDDVVVATNNGNFSRSLRYLHLNGKIRKDIDPSLPSKVETNWEVVEFCSHHYHVMTLKDGRRIIVPCREQNEIIGRGRIQKGGLVTLAESACLAKAYGQMWALYFFHRRDLRMAFLAITSSVPIDWFPEGRTSWSIHQNKEWMTTEDMLRVWNTVWIQDNPWMEDKMEIENWRDIPYLPKSMDLKCGSLIGTKERAAWSKDLPSTVTAVRKIIDQDTKTENVYQDFLGGMGRFQTYTDPMAT

SEQ ID NO: 403 - protein, 3484 aa, Artificial Sequence
  synthetic
LSLVLIKRLQLPTSMYLIPLMNQERGILRGMGRFPPPPVKKGNKNSVAVARVPPQQGGKAREKNRERIKAPGARHGVAGKMKSLMGELGFGWIDLLRVDLVEGIMMMVFVIQRAFAQVHRRIRGLSRRVRALEKKRDGRAAMFIWTILAMLFGVMGAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADFGCGFDPDRKVAQCGSGSFVWKSLARWPMADHAIEFEDSKVMVTYLTDLLMRKNKVCIVCEDVLQCAAARGVVEQITSINGIPIHHNMSLSHGRYFPRVVKKVHNVKVGKAMLRLAMATYAGAMPESGLGVLKTGYFSRGEVQETWDDKVLRVLTSAINAEEVCQTAVTFQYEFVRYNRKVFGSNIVLRPSAFTSKACPTYLAGAVVKNDIATFTDGMMWMRSRKVNETWELFELETTQSHQCIWPYAYTIDLATPTDKRLFMPPQYGGPISFANHVPGFQVQEDFPWQKANILMRQGPVPGTTVVQDPHCDDRSAAVPVEPTMQAWCCKTCFDRGVKPFHFVVDGKFFYPMEVRPMKLEQDAVVIETDDGEFERSEHESLFEGKAKWTSPLPMGETAKIQNFFVTSPPKPESSLLLVGVLIHMLTTRTRHRWATRCAGTWLIFLVFGHPVVSSVQSWAWLFMSAALASVPGGSSLVIHFWIGLQISSAHLFYLGWLMRKRLLITEMSRVAHLIAQLCSFETYAWAPILKVLDHLLFPLYTLSVFVVHQQFQVFHDLWLQSAVVMAHLLQHPLSGLITLSLSVGLIQLIAPMKRWFCSPVIWGDGLRAPRPHWTALTYFIVLYLAAAGMETVGLHTSGMTVMLGGMLLWVVLQLMPPTALELVRLPGQSLPDGCEEEASTSLPEGMSGHYAPDGVELVNYTDAGTVSANLVVFVGCAGIMTMNIYVGLVITALAWVTDAPMWIPRLIDGAMSQRANSELLLPSPPLEIHKTEDSFGYIPDGTYHVLASSWMSKKPVGVGVVKEGVFHTLHHVTKGANVTWAGREVRMHSGDVRRDIAAYGGPWNISGSLEDVVVVKAVNKDGTVTCCRITTAKLDIEGTTVMAVERDFGFGSSGSPIYAPDGRLIGLYGYGFYYGTYFSIVSTGEGVEAPPEEVEVSTREFVDWHPGRGKTRTILVEQALKHIADGKRLLILTPTRVVKDEVQRAIKEAAPQAVIGSNLSIFRKNAVTLACHATFTQYVMEKGIESVKFSTIIMDECHFLDPMSIACRGIMDFHNSRGTKVIFMSATPPGRAGNAGSNFTIEDRAIKFPKELTASWIKDKSIGKTIVFVPTITQAVRLAKELGGVALTRDTFNDAMGKARSPETMFIISTDISEMGANLGVTTVIDTRTVIKPLVSDKGVSLERVGVTPASIIQRRGRVGRREPGVYIYPLDVEPEEQPENWVCWVEAQMILDQLGCHPMREESEFFRPQGTYRIDDVEQRRFLGLIKEKLPIWLAWTWASSHANKHQMLFQGNAPNTGRTLKIKTPSGSHIYAPKVTDDRFEKEPEIVKVAAIGFFLKQRSLYFDLPGLLTGLYTVLTTAGLDALGNSFKRSVDTLHDIGNAVEGEFSAIQMGRILQMWSALFIGVTLGVVLMGAGFVVVKAFRGLFGTRQQHTTVCVSEGGSFQKVATVLMSVGPLCAVFGGIPSIFVFIVTVALLIVLCVGGGGSQRGVLDSDLIRWVMVLAMMTIGVTAWELELLPNVRRDVIQLTRYLFASNPAVVGAVFNAGNIGLGVSLPGTLMMSYAASGTLAPLIGAWAEGNFLGKLFGSEVLPAQAIGGFQVTAIPWGSMVPVIAGCFLATNTLSKVFGAGITTVFLILLYFDKKHAFTNKAVKVLLARTNRRDMEEEITTRDAESRARQLFYGLQLAVSLLWVLSHPVLENFVPFFAVCGYTFLSLLRPNHQLHAALDYTLVVLLLQVVEPGNIMYVGGCVLLWYVLNPTRLGVRSLVKSDTGGLGFRWKKALNSLSERQFAIYKVRGVNETDKGAYVSRGGLKMNEIINKHAWEPRGVVVDLGCGRGGWSQRLVMDYRVAEVRGYTLGGKERENPQPFQTKGYNLANLKAGVDVYKMEPVNCNTIICDIGESDPRPEVEKTRTLKVLGMLEKWLEVNPNASFCCKVLSPYHLDVLRKLESLQHKYNGRLVRLSYSRNSTAEMYYVSGKRANVVASVYFMLGSLVGRLRRHEPSIIDPPPVLEMGTRSDPRAKAKAQDFEMIRRRVERLRGENRKTWFVDNEHPYVSFNYHGSFVTDEVTAGGQTTNPLIRRVMWPWDFLSRVTTFMMTDVSTYAQQKVLREKVDTVSEEPDERMKAINRLIMTHFVKMFKRRGLKPRVLTPQDYMNNVQANAAIGGWSEVMDWQNVRDALADQRFWDMVDNERALHLRGDCELCIYNTMGKKEKKPSAFGTAKGSRTIWYMWLGSRYLEYEALGFLNEDHWVARENFPCGVGGVGVNYFGYYLKEIAGGGRWLIADDVAGWDTRITQGDLDDELFMLTELAPTTYHKKLITATMTLAYKNIVALFPRNHPMYRSGTVLDVLSRTDQRGSGQVTTYALNTVTNGKCQVGRTLEACGLLDAPLTTIDSWLTANLERVLGAMVVAGDDVVVATDNEEFHTSLRYITATSKIRKNLGVSEPSPRFTSWEDVEFCSHHFHPLTLRDGRVLIAPCRDQNEIIGRSRIQKGGIVDMASAGCLAKAHAQMWALYFFHRRDLRIGFAAITSIVPINWVPTGRISWSIHQNAEWMTTEDMLTVWNNVWIRDNPWMRGKERVTSWTDIPYLPKGVDIKCGSLIGDSDRASWSKTIPLVVEKTRKILEQERGTLKFYNGLSILGRYVHHVDPVFN

SEQ ID NO: 404 - protein, 3464 aa, Artificial Sequence
  synthetic
MNQERGILRGMGRFPPPPVKKGNKNSVAVARVPPQQGGKAREKNRERIKAPGARHGVAGKMKSLMGELGFGWIDLLRVDLVEGIMMMVFVIQRAFAQVHRRIRGLSRRVRALEKKRDGRAAMFIWTILAMLFGVMGAEVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSADFGCGFDPDRKVAQCGSGSFVWKSLARWPMADHAIEFEDSKVMVTYLTDLLMRKNKVCIVCEDVLQCAAARGVVEQITSINGIPIHHNMSLSHGRYFPRVVKKVHNVNVGKAMLRLAMATYAGAMPESGLGVLKTGYFSRGEVQETWDDKVLRVLTSAINAEEVCQTAVTFQYEFVRYNRKVFGSNIVLRPSAFTSKACPTYLAGAVVKNDIATFTDGMMWMRSRKVNETWELFELETTQSHQCIWPYAYTIDLATPTDKRLFMPPQYGGPISFANHVPGFQVQEDFPWQKANILMRQGPVPGTTVVQDPHCDDRSAAVPVEPTMQAWCCKTCFDRGVKPFHFVVDGKFFYPMEVRPMKLEQDAVVIETDDGEFERSEHESLFEGKAKWTSPLPMGETAKIQNFFVTSPPKPESSLLLVGVLIHMLTTRTRHRWAARCAGTWLIFLVFGHPVVSSVQSWAWLFMSAALASVPGGSSLVIHFWIGLQISSAHLFYLGWLMRKRLLITEMSRVAHLIAQLCSFETYAWAPILKVLDHLLFPLYTLSVFVVHQQFQVFHDLWLQSAVVMAHLLQHPLSGLITLSLSVGLIQLIAPMKRWFCSPVIWGDGLRAPRPHWTALTYFIVLYLAAAGMETVGLHTSGMTVMLGGMLLWVVLQLMPPTALELVRLPGQSLPDGCEEEASTSLPEGMSGHYAPDGVELVNYTDAGTVSANLVVFVGCAGIMTMNIYVGLVITALAWVTDAPMWIPRLIDGAMSQRANSELLLPSPPLEIHKTEDSFGYIPDGTYHVLASSWMSKKPVGVGVVKEGVFHTLHHVTKGANVTWAGREVRMHSGDVRRDIAAYGGPWNISGSLEDVVVVKAVNKDGTVTCCRITTAKLDIEGTTVMAVERDFGFGSSGSPIYAPDGRLIGLYGYGFYYGTYFSIVSTGEGVEAPPEEVEVSTREFVDWHPGRGKTRTILVEQALKHIADGKRLLILTPTRVVKDEVQRAIKEAAPQAVIGSNLSIFRKNAVTLACHATFTQYVMEKGIESVKFSTIIMDECHFLDPMSIACRGIMDFHNSRGTKVIFMSATPPGRAGNAGSNFTIEDRAIKFPKELTASWIKEKSIGKTIVFVPTITQAVRLAKELGGVALTRDTFNDAMGKARSPETMFIISTDISEMGANLGVTTVIDTRTVIKPLVSDKGVSLERVGVTPASIIQRRGRVGRREPGVYIYPLDVEPEEQPENWVCWVEAQMILDQLGCHPMREESEFFRPQGTYRIDDVEQRRFLGLIKEKLPIWLAWTWASSHANKHQMLFQGNAPNTGRTLKIKTPSGSHIYAPKVTDDRFEKEPEIVKVAAIGFFLKQRSLHFDLPGLLTGLYTVLTTAGLDALGNSFKRSVDTLHDIGNAVEGEFSAIQMGRILQMWSALFIGVTLGVVLMGAGFVVVKAFRGLFGTRQQHTTVCVSEGGSFQKVATVLMSVGPLCAVFGGIPSIFVFIVTVALLIVLCVGGGGSQRGVLDSDLIRWVMVLAMMTIGVTAWELELLPNVRRDVIQLTRYLFASNPAVVGAVFNAGNIGLGVSLPGTLMMSYAASGTLAPLIGAWAEGNFLGKLFGSEVLPAQAIGGFQVTAIPWGSMVPVIAGCFLATNTLSKVFGAGITTVFLILLYFDKKHAFTNKAVKVLLARTNRRDMEEEITTRDAESRARQLFYGLQLAVSLLWVLSHPVLENFVPFFAVCGYTFLSLLRPNHQLHAALDYTLVVLLLQVVEPGNIMYVGGCVLLWYVLNPTRLGVRSLVKSDTGGLGFRWKKALNSLSERQFAIYKVRGVNETDKGAYVSRGGLKMNEIINKHAWEPRGVVVDLGCGRGGWSQRLVMDYRVAEVRGYTLGGKERENPQPFQTKGYNLANLKAGVDVYKMEPVNCNTIICDIGESDPRPEVEKTRTLKVLGMLEKWLEVNPNASFCCKVLSPYHLDVLRKLESLQHKYNGRLVRLSYSRNSTAEMYYVSGKRANVVASVYFMLGSLVGRLRRHEPSIIDPPPVLEMGTRSDPRAKAKAQDFEMIRRRVERLRGENRKTWFVDNEHPYVSFNYHGSFVTDEVTAGGQTTNPLIRRVMWPWDFLSRVTTFMMTDVSTYAQQKVLREKVDTVSEEPDERMKAINRLIMTHFVKMFKRRGLKPRVLTPQDYMNNVQANAAIGGWSEVMDWQNVRDALADQRFWDMVDNERALHLRGDCELCIYNTMGKKEKKPSAFGTAKGSRTIWYMWLGSRYLEYEALGFLNEDHWVARENFPCGVGGVGVNYFGYYLKEIAEGGRWLIADDVAGWDTRITQGDLDDELFMLTELAPTTYHKKLITATMTLAYKNIVALFPRNHPMYRSGTVLDVLSRTDQRGSGQVTTYALNTVTNGKCQVGRTLEACGLLDAPLTTIDSWLTANLERVLGSMVVAGDDVVVATDNEEFHTSLRYITATSKIRKNLGVSEPSPRFTSWEDVEFCSHHFHPLTLRDGRVLIAPCRDQNEIIGRSRIQKGGIVDMASAGCLAKAHAQMWALYFFHRRDLRIGFAAITSIVPINWVPTGRISWSIHQNAEWMTTEDMLTVWNNVWIRDNPWMRGKERVTSWTDIPYLPKGVDIKCGSLIGDSDRASWSKTIPLVVEKTRKILEQERGTLKFYNGLSILGRYVHHVDPVFN

SEQ ID NO: 405 - protein, 3241 aa, Artificial Sequence
  synthetic
  misc_feature (498)..(498): Xaa can be any naturally occurring amino acid
KTMNGIMDKGEHVWKADWNVDFTNVKLPKDFCGSGIHVEKMCPQVDSLQDATIDCAGRHDQFLLSYTRCAAKNRVKRGEPGVVEPKVTNIWTITFNDELNSIIERVSGMLKNNRLMATAVICLVGAFKKWPTWLVVLLVLLPWTVVQASLADPFLILPKGDGLVKTRLYPGQISSISTHVGVLDISYMAVDIEEGRLVERLMSHCEVNGTYSQDCCALGCNLDLSKLNERNRACQTATYNRGWATGCPVFGLGSVATCVEVACSDSVEVSELTSQNIRIPLSLRLQHEELNVTMTTEAPVTSKFSHHGVVSISCQIGNPGFLAQQYVLSNGKHKAMFPISAVSGWPGIREIGGQYRNVDGSVKWGHVEANEIKVAAVYSDSIQWKTGIPIKTGIRDPLYLYCEVSLTDLTFKKIRACESPVEVSFMAGPTGLDGRLEIGLLEQVNKTCSITGSCEGCTLPHPTSVISTSDKKGHMHVECRTGTFTAIFGKQKFSFTCXTSYLRTIWATTAQAIGNYRKFGLDASGGPFLDLWNKIGPNFSRLEVVGILVVAALLIDKRLLLLLAIFGYVTYVRADIGCGIDFDRKTYTCGSGLFVWKGLGKYPTADHSVEFASYDFLSAYLQEQFKSEKKVCIICEDIVQCEAARKAAAAVYKNLGHPFVYVNTSDSYGKVFAEIPKRVHTVSVGVDVVEMAMMTRENKPVGPFGDLPRSMVSWKSIPETEEHPVLRVLTSSSDYQKVCGKAIGFQYDFVGYRRTMYGSNVQLKISKKVSIECPTYLAGVAVKNDRTVFTDGMFWMSSKRENGTYAITELEMEQSHKCIWPDQYTPDATLTPRDNEMFVPPEWGGPMSKANHIPGYKMQTGFPWNKAPIRFVEGSVPGTIVTQISHCDGRGIAAEVNPATQPNWCCKSCTRIFHFEVDGKLYYPMEIRPDPKGGEQQKVPVVETPIGDEETETVGGWLGRMYNIPGAEGSYADFRLPKLPNSRPSAMVGSLVNLLCLMFSIQIVTKTMRARTLMRFYLCCLVFMFFGMPTLFGLSGFLAWMMILPISHNSVTMCNLTVHLWAVLLNQSSAMFLWGLTLRSQIQRSTAGQMLLFTMQMLHHAIYAHSWVFGWVIEVCLSVGLMMNLLTVIDTVHPKLIAYLLFFGWKTGMCVVCAWLLIYSIRRWNSIVAAAPAAGGWRSGYRTMMSSSLIVIFISVGIAGVIASDYGGYPAAAAVTAALLIMGIKMFDFLTTRLSLEFVSAGMFPEGVEKAFEPDSVSDLFRASFTVDGIKLQDHVEPIPILFAILYIFIGAVACKVNPALGIVYAIAMFATPLPELMRLYMMTIYSSTFRTDTLLGMAIPETEPELSQDFGPIPDGIYRVNNHGFSVKSHRGVGIVKNGVFHTLMHVTLNEPLAWQNRLVGPSMGHSLKDYVTYGGNWQLPDFDIVNEVGIMVCGRDRSIQYKRHEVGTIMIDDKRVMYFTHDYGHGSSGSPIFVNGEPVALYGFGFHLYNRYRSIVLPIPREEVLDGASNEGIPAEHGTMRNKFFVDWHPGKGKTRKVIVKEVLNALNLARRIVVLAPTRVVLAEITKAIGENTSKTPSKNLAFTGHNIVTVACHATFTDYVLRHGLSKFKAHEVIMDECHFLDPRSIAARGILEHLATKRGVKVTFMSATIPGREPSLGSNFEISEQALQFPRDVNQRWIETVARGKTVAFVPSHRVGDKLARGCPQAISLHRNNFDTNYSTAMDESIKFIYTTDISEMGANFSADTVIDFRVAIKPKISSEFAVTLEPTPITRSSMIQRRGRVGRQRPGTYIYPVDKGVEDASDQLACWTEAQMLLDQLDLTMMAEEVRQSNIPGAYKLVGRSLDIFRKLLEKDDIPIWLSWKWADSVQQQYSILFEGERQENVARVVNTRDYASLEYKPKFVDARFERLGWDQRKLSIQFYMNTRSFITFATLSHVISQVIEAGVVNSAWKRIGDVSIIFTEGGDPHAKDETIMAWTILVGGVLGALGFLIVAWGMKAVLRVIFGSRDKHLSVPTLVADFQPYIVCIVPIALHLAGVPIPMTIVFFAMLFLTYPLMYKSAGQRSYVDIDLVKWILLGGCIVTGVICWEMRLLPNISSDISAILNRQRQREDTPTFDASPPWEWLDLAQPVPHNVELTSVVITTFTTWLFLHQIVGWSYESEWLKSYFDHKGVGQIMGGFRLDTISWGSALSGLLGTATYASWGAILTGLGGAVVYFFLMVSMLKWNFSGGATTGLENNVMRNDRETGLGNRPANDNRRSLLYGVVAAECLVWLFCFRTATDAIVVACLVSYCLWIINNPASPHHKNTDLGSACSFIGLLYCTCPTQKCIQVLMRFALARLNMNTRSLEKSATGGLGHRWKKLLNAMTLLEFNAYRSCGVDETEKGDYVSRGGLKLREITMKYGWKPEGICVDLGCGRGGWSQHLAMDPRVTRVESFTLGGTARENPQPIKTLGHNLIRFKSGVNVYNMTPTHANTIVCDIGESDPKPEVETSRTLRVLKTLELWLARNPNAEFVCKVLCPYPVEVLKCLETLQHKYGGRIIRSTYSRNSSAEMYYISGGRNNMVKVIFTTLHSLISRIRTRPEKIVKESVSLPVGTRSDPGHKIKSMDPKMIATRVEKIKKEHADTWFVDNNHPYQSFRYVGSYVTDDVTPGGQTVNPLMRKMMWPWETVGGVVNFMMTDVSTYAQQKVLREKVDTLSPEPPNDIQRVNRWITEFLCASFMRRGLKPRILTMEQYINNVKSSAAIGSWSSDVPWSSVREALADKRFHQMVEEERKLHLAGDCRMCVYNTMGKKEKKPSAMGVAKGSRTIWYMWLGSRFLEYEALGFLNEDHWVSRDNLACGVGGVGVNYFGYYLQEIARKGKFFIADDIAGWDTRINESDLADEEFLIMSLICDPYHRSLAKAVFRFAYQNIVALFPRNHPGFGSGTVMDVVARTDQRGSGQVVTYALNTITNAKIQLGRMLEAEGLLDAHEHVIKKWLNDNGEEALSGMVVAGDDVVVATNNGNFSRSLRYLHLNGKIRKDIDPSLPSKVETNWEVVEFCSHHYHVMTLKDGRRIIVPCREQNEIIGRGRIQKGGLVTLAESACLAKAYGQMWALYFFHRRDLRMAFLAITSSVPIDWFPEGRTSWSIHQNKEWMTTEDMLRVWNTVWIQDNPWMEDKMEIENWRDIPYLPKSMDLKCGSLIGTKERAAWSKDLPSTVTAVRKIIDQDTKTENVYQDFLGGMGRFQTYTDPMATV

SEQ ID NO: 406 - protein, 88 aa, Binjari Virus
SMSKFAEYKRYCLQATMSDVTSIVACPGAGDAHNDKSKNHEYICKAVNNDRGWGNGCVLFGKGSMETCGKFECKKKMAGKLVARENVE

SEQ ID NO: 407 - protein, 88 aa, Lilly Creek Virus
LVKDPPVLRTYCIEPTITDTSTVNKCPSMGEAYNPKRKDHQYVCLRSPSGRGWGNGCALFGTGSVDTCAKFACAKKLRGKQALTENVE

SEQ ID NO: 408 - protein, 88 aa, Nounan? virus
EMTKLAKVRAYCLTASVSDITVESGCPGTGEIHNTKAKDTSYMCKVSYPDRGWGNGCGLFGKGSMETCAKFACTKQLHGHVISRENIE

SEQ ID NO: 409 - protein, 88 aa, Nhumirim virus
EVTNPAVLRKLCIEAKISNTTTDSRCPTQGEATLVEEQDTNFVCRRTFVDRGWGNGCGLFGKGSLITCAKFKCVTKLEGKIVQYENLK

SEQ ID NO: 410 - protein, 88 aa, Ilomantsi virus
TMTKFADYKRYCLQATMTDVTSIVACPGAGDAHNDKSKNHDYICKAVTNDRGWGNGCVLFGKGSMETCGKFECKKKMAGKLVARENVE

SEQ ID NO: 411 - protein, 88 aa, Chaoyang virus
EISKLAKVREYCLQASITDTTTVAGCPSTTEAHNDKRKDALYLCERSYPDRGWGNGCGLFGRGSLDTCAKFACSKKFSGHMLQRENLA

SEQ ID NO: 412 - protein, 88 aa, Lammi virus
EASQLAEVRSYCYHASVTDISTVARCPTTGEAHNEKRADSSYVCKQGFTDRGWGNGCGLFGKGSIDTCAKFSCTSKAIGRTIQPENIK

SEQ ID NO: 413 - protein, 88 aa, Barkedji virus
EITKMAAIRSYCLKASTSDASSVSGCPGTGEVHNTKAEDTAFICKSSNPDRGWGNGCGLFGKGSMETCAKFTCDKKLAGHVISRENIE

SEQ ID NO: 414 - protein, 88 aa, Japanese Encephalitis virus
RLTSMAKIRTYCLEGAISDTSTVSRCPSMGEAYNEKRKDTSYVCHQGTSGRGWGSGCGLFGQGSLDTCGKFACSKKMIGYKATVENIE

SEQ ID NO: 415 - protein, 88 aa, West Nile virus
VAKKPAHVRKVCLEASITEISHVATCPTNGDAHNPKAKDTLFMCKRELTDRGWGSGCAFFAKGSLESCCKFACKKSYDASVITRENIE

SEQ ID NO: 416 - protein, 88 aa, Dengue virus
  misc_feature (43)..(43): Xaa can be any naturally occurring amino acid
EAANLAEVRSYCYLATVSDLSTKAACPTMGEAHNDKRADPAFXCRQGVVDRGWGNGCGLFGKGSIDTCAKFACSTKAIGRTILKENIK

SEQ ID NO: 417 - protein, 88 aa, Zika virus
TVSNMAEVRSYCYEASISDMASDSRCPTQGEAYLDKQSDTQYVCKRTLVDRGWGNGCGLFGKGSLVTCAKFTCSKKMTGKSIQPENLE

The invention claimed is:

1. A chimeric flavivirus polyprotein comprising:
   (i) a polyprotein backbone encoded by the genome of a Lineage II insect-specific flavivirus; and
   (ii) an immunogenic amino acid sequence of a protein encoded by a genome of a flavivirus that is not insect-specific;
   wherein the immunogenic amino acid sequence replaces a corresponding amino acid sequence of the polyprotein backbone, and wherein the immunogenic amino acid sequence is selected from the group consisting of:
   a) a prM protein;
   b) an Envelope protein, or one or more of an EDI, EDIT, and EDIII domain thereof, and
   c) a combination of a) and b).

2. The chimeric flavivirus polyprotein of claim 1, wherein the insect-specific flavivirus of (i) is capable of infecting a plurality of different insects.

3. The chimeric flavivirus polyprotein isolated protein of claim 1, wherein the insect-specific flavivirus of (i) is selected from the group consisting of Binjari virus (BinJV); Lilly Creek Virus (LiCV); Ilomantsi virus (ILOV); Donggang virus (DONV); Marisma mosquito virus (MMV); Chaoyang virus (CHAOV); Lammi virus (LAMV); Barkedji virus (BJV); Nhumirim virus (NHUV); Nounané virus (NOUV); and Nanay virus (NANV).

4. The chimeric flavivirus polyprotein of claim 1, wherein the immunogenic amino acid sequence (ii) is of a protein encoded by the genome of a vertebrate-infecting flavivirus.

5. The chimeric flavivirus polyprotein of claim 1, wherein the immunogenic sequence (ii) is of a protein encoded by the genome of a flavivirus selected from the group consisting of Zika virus; West Nile virus; Dengue virus; Japanese encephalitis virus; Yellow fever virus; tick-borne encephalitis virus; St Louis encephalitis virus; Murray valley encephalitis virus; Duck tembusu virus; Turkey Meningoencephalitis Virus; Usutu virus; Sepik virus; Wesselsbron virus; Baiyangdian Virus; and Sitiawan Virus.

6. The chimeric flavivirus polyprotein of claim 1 comprising an amino acid sequence set forth in a sequence selected from the group consisting of SEQ ID NOS: 32, 389, 391, 395, and 393.

7. The chimeric flavivirus polyprotein of claim 1, which is encoded by a nucleotide sequence set forth in a sequence selected from the group consisting of SEQ ID NOS: 33, 386, 388, 390, 392, and 394.

8. An isolated nucleic acid encoding the chimeric flavivirus polyprotein of claim 1.

9. A genetic construct comprising the nucleic acid of claim 8.

10. An isolated host cell comprising the genetic construct of claim 9.

11. An isolated chimeric insect-specific flavivirus comprising the proteins of the chimeric flavivirus polyprotein of claim 1.

12. A vector comprising:
   (i) the nucleic acid of claim 8; and
   (ii) an insect-specific promoter operably connected to the nucleic acid of (i).

13. A method of producing an isolated chimeric insect-specific flavivirus, the method including the steps of:
   (a) combining a vector comprising (i) a nucleotide sequence capable of replicating the chimeric insect-specific flavivirus, the chimeric insect-specific flavivirus comprising: the proteins of the chimeric flavivirus polyprotein of claim 1; and a nucleic acid that encodes said chimeric flavivirus polyprotein of claim 1; and (ii) an insect-specific promoter operably connected to (i), with an insect cell; and
   (b) allowing said chimeric insect-specific flavivirus replicable by (i) to replicate in the insect cell,
   to thereby produce the isolated chimeric insect-specific flavivirus.

14. The method of claim 13, wherein one or more mutations are incorporated into the chimeric insect-specific flavivirus during replication in an insect cell.

15. A method of eliciting an immune response in a subject in need thereof comprising administering an effective amount of a pharmaceutical composition to the subject, wherein the pharmaceutical composition comprises one or more group members selected from the group consisting of:
   (a) the chimeric flavivirus polyprotein of claim 1;
   (b) a genetic construct comprising a nucleic acid that encodes the chimeric flavivirus polyprotein of (a);
   (c) a vector comprising a nucleic acid that encodes the chimeric flavivirus polyprotein of (a) and an insect-specific promoter operably connected to the nucleic acid of (b); and
   (d) an isolated chimeric insect-specific flavivirus comprising the proteins of the chimeric flavivirus polyprotein of (a); and a nucleic acid that encodes said chimeric flavivirus polyprotein of (a).

16. A method of detecting, identifying or screening for an antibody in a sample, the method including the steps of combining a diagnostic composition with the sample, the diagnostic composition comprising one or both group members selected from the group consisting of:
   (a) the chimeric flavivirus polyprotein of claim 1 and
   (b) an isolated chimeric insect-specific flavivirus comprising the chimeric flavivirus polyprotein of (a); and a nucleic acid that encodes said chimeric flavivirus polyprotein of (a);
   wherein binding of an antibody in the sample to an immunogenic amino acid sequence of the chimeric flavivirus polyprotein or the isolated chimeric insect-specific flavivirus of the diagnostic composition facilitates detecting, identifying or screening for the antibody in the sample.

17. The chimeric flavivirus polyprotein of claim 1, wherein the immunogenic amino acid sequence (ii) is a prM protein and an Envelope protein.

18. The chimeric flavivirus polyprotein of claim 4, wherein the vertebrate-infecting flavivirus is selected from the group consisting of a mammalian-infecting flavivirus; a human-infecting flavivirus; an avian-infecting flavivirus; and a reptile-infecting flavivirus.

19. The chimeric flavivirus polyprotein of claim 1, further comprising a non-structural protein encoded by the genome of the flavivirus that is not insect specific.

20. The chimeric flavivirus polyprotein of claim 19, wherein the non-structural protein is NS1.

21. The chimeric flavivirus polyprotein of claim 1, which is capable of forming a virus particle.

22. The chimeric flavivirus polyprotein of claim 1, wherein the Lineage II insect-specific flavivirus of (i) is selected from the group consisting of Binjari virus (BinJV); Lilly Creek Virus (LiCV); Ilomantsi virus (ILOV); Donggang virus (DONV); Marisma mosquito virus (MMV); Chaoyang virus (CHAOV); and Lammi virus (LAMV).

23. The chimeric flavivirus polyprotein of claim 1, wherein the genome of the Lineage II insect-specific flavivirus is genetically modified.

24. The chimeric flavivirus polyprotein of claim 1, wherein the immunogenic amino acid sequence (ii) is an amino acid sequence set forth in SEQ ID NO: 8, 9 or 10.

25. The chimeric flavivirus polyprotein of claim 1, wherein the immunogenic sequence (ii) is the EDIII domain of the E protein encoded by the genome of the flavivirus that is not insect-specific.

26. The chimeric flavivirus polyprotein of claim 1, wherein the polyprotein backbone comprises the amino acid sequence of SEQ ID NO: 387 or 397.

27. The chimeric flavivirus polyprotein of claim 1, wherein the polyprotein backbone comprises the amino acid sequence encoded by the nucleotide sequence of SEQ ID NO: 386 or 396.

* * * * *